(12) United States Patent
Brugere et al.

(10) Patent No.: US 10,238,695 B2
(45) Date of Patent: Mar. 26, 2019

(54) USE OF MICROORGANISMS FOR REDUCING THE LEVEL OF TRIMETHYLAMINE IN A HUMAN BODY CAVITY, IN PARTICULAR FOR THE TREATMENT OF TRIMETHYLAMINURIA OR OF BACTERIAL VAGINOSIS AND THE PREVENTION OF CARDIOVASCULAR DISEASES

(71) Applicant: UNIVERSITE D'AUVERGNE CLERMONT I, Clermont Ferrand (FR)

(72) Inventors: Jean-François Brugere, Issoire (FR); Guillaume Borrel, Gieres (FR); Paul William O'Toole, Mallow Co Cork (IR); Corinne Malpuech-Brugere, Issoire (FR); Monique Alric, Saint Flour l'Etang (FR)

(73) Assignee: UNIVERSITE D'AUVERGNE CLERMONT I, Clermont Ferrand (FR)

( * ) Notice: Subject to any disclaimer, the term of this patent is extended or adjusted under 35 U.S.C. 154(b) by 0 days.

(21) Appl. No.: 14/648,186

(22) PCT Filed: Sep. 27, 2013

(86) PCT No.: PCT/EP2013/070249
§ 371 (c)(1),
(2) Date: May 28, 2015

(87) PCT Pub. No.: WO2014/082773
PCT Pub. Date: Jun. 5, 2014

(65) Prior Publication Data
US 2016/0074440 A1 Mar. 17, 2016

(30) Foreign Application Priority Data

Nov. 30, 2012 (FR) ...................................... 12 61507
Mar. 13, 2013 (FR) ...................................... 13 52239
Jul. 15, 2013 (FR) ...................................... 13 56937

(51) Int. Cl.
*A61K 35/74* (2015.01)
*C12N 9/10* (2006.01)
*A61K 38/45* (2006.01)

(52) U.S. Cl.
CPC .............. *A61K 35/74* (2013.01); *A61K 38/45* (2013.01); *C12N 9/1007* (2013.01); *C12Y 201/0125* (2015.07); *Y02A 50/473* (2018.01)

(58) Field of Classification Search
None
See application file for complete search history.

(56) References Cited

U.S. PATENT DOCUMENTS 9,168,233 B2  10/2015  Hazen et al.
9,694,020 B2   7/2017  Hazen 2011/0280835 A1*  11/2011  March ................ C07K 14/4705
                                               424/93.2
2012/0157397 A1*   6/2012  Hazen .................... C12Q 1/025
                                                  514/39
2013/0345171 A1   12/2013  Hazen et al.
2016/0089386 A1    3/2016  Hazen
2016/0089387 A1    3/2016  Hazen
2016/0101062 A1    4/2016  Hazen et al.

FOREIGN PATENT DOCUMENTS

CN       102458481        5/2012
WO    WO-92/20789       11/1992
WO   WO 9951753 A1 *  10/1999  .......... C07K 14/245
WO    WO-02/061425      8/2002
WO   WO-2010/138899    12/2010

OTHER PUBLICATIONS

Genbank Accession No. AGI85869.1.*
Fog Bentzon et al. Mechanisms of Plaque Formation and Rupture. Circulation Research, 2014. 114:1852-1866.*
Sakakura et al. Pathophysiology of Atherosclerosis Plaque Progression. Heart, Lung and Circulation, 2013. 22:399-411.*
Jia et al. Gut Microbiotia: A potential New Territory for Drug Targeting. Nature Reviews, 2008. 7:123-129.*
Chin et al. In sight of current technologies for Oral Delivery of Proteins and peptides Drug Discovery Today: Technologies, 2012: 9(2) e105-112.*
Paul et al (The Trimethylamine Methyltransferase Gene and Multiple Dimethylamine Methyltransferase Genes of Methanosarcina barkeri Contain In-Frame and Read-Through Amber Codons. Journal of Bacteriology, 2000. 2520-2529.*
GenBank Accession No. NZ_CAJE01000023.*
Genbank Accession No. NZ_CAJE01000013.*
Begley et al. Bile Sale Hydrolase Activity in Probiotics. Applied and Environmental Microbiology, 2006. 1729-1738.*
Krzycki, Joseph A. The Direct Genetic Encoding of Pyrrolysine. Current Opinion in Microbiology, 2005. 8:706-712.*
Wang, et al., "Gut flora metabolism of phosphatidylcholine promotes cardiovascular disease", Apr. 7, 2011, pp. 57-63, vol. 472, No. 7341, Nature.

(Continued)

Primary Examiner — Christopher M Babic
Assistant Examiner — Kimberly A. Aron
(74) Attorney, Agent, or Firm — B. Aaron Schulman, Esq.; Stites & Harbison, PLLC

(57) ABSTRACT

Composition containing a microorganism, preferably an Archaea, expressing a TMA methyltransferase and a TMA methyl group acceptor corrinoid protein, capable of metabolizing trimethylamine (TMA) in the presence of hydrogen in a human cavity, such as the intestine or the vagina, for use as a medicament for treating, reducing or eliminating TMA at the level of the human cavity. In addition, a composition containing a TMA methyltransferase and a TMA methyl group acceptor corrinoid protein. These compositions are of use for treating trimethylaminuria, for treating vaginal fluids in the case of bacterial vaginosis and for reducing or eliminating odours due to TMA. These compositions are also of use for reducing the level of plasma TMAO, for preventing the formation of atheroma plaques and/or for preventing cardiovascular diseases.

10 Claims, No Drawings
Specification includes a Sequence Listing.

(56) References Cited

OTHER PUBLICATIONS

Koeth, et al., "Intestinal microbiota metabolism of L-carnitine, a nutrient in red meat, promotes atherosclerosis", Apr. 7, 2013, pp. 1-11, nature medicine.
International Serach Report dated Nov. 21, 2013 in PCT/EP2013/070249.
Chalmers, et al., "Diagnosis and management of trimethylaminuria (FM03 deficiency) in children", Feb. 1, 2006, pp. 162-172, vol. 29, No. 1, Journal of Inherited Metabolic Disease, Kluwer Academic Publishers, DO.
Dridi, et al., "Archaea as emerging organisms in complex human microbiomes", Mar. 8, 2011, pp. 56-63, vol. 36, No. 3, Anaerobe, XP028094572.
Mastromarino, et al., "Bacterial vaginosis: a review on clinical trials with probiotics", Jul. 1, 2013, pp. 229-238, vol. 36, No. 3, New Microbiologica, XP009172723.
Vujic, et al, "Efficacy of orally applied probiotic capsules for bacterial vaginosis and other vaginal infections: a double-blind, randomized, placebo-controlled study", May 1, 2013, pp. 75-79, vol. 168, No. 1, European Journal of Obstetrics & Gynecology and Reproductivebiology, Excerpta Medica, Amsterdam, NL, XP009172718.
Rak, et al., "The diet-microbe morbid union", Apr. 7, 2011, pp. 40-41, vol. 472, News & Views, Cardiovascular Disease.
Dridi, et al, "Age-related prevalence of *Methanomassiliicoccus luminyensis* in the human gut microbiome", 2012, pp. 1-5, Human Intestinal Archaea.
Wolrath, et al., "Trimethylamine and trimethylamine oxide levels in normal women and women with bacterial vaginosis reflect a local metabolism in vaginal secretion as compared to urine", 2005, pp. 513-516, vol. 113, APMIS.
Wolrath, et al, "Trimethylamine content in vaginal secretion and its relation to bacterial vaginosis", 2002, pp. 819-824, vol. 110, APMIS.
Gorlas, et al, "Complete Genome Sequence of *Methanomassiliicoccus luminyensis*, the Largest Genome of a Human-Associated Archea Species", Sep. 2012, pp. 4745, vol. 194, No. 17, Journal of Bacteriology.
Dridi, et al., "*Methanomassiliicoccus luminyensis* gen. nov., sp. no., a methanogenic archeaeon isolated from human feaces", 2012, pp. 1902-1907, vol. 62, International Journal of Systematic and Evolutionary Microbiology.
Ferguson, et al., "RamA, a Protein Required for Reductive Activation of Corrinoid-dependent Methylamine Methyltransferase Reactions in Methanogenic Archaea", Jan. 23, 2009, pp. 2285-2295, vol. 284, No. 4, The Journal of Biological Chemistry.
Vujic, et al., "Efficacy of orally applied probiotic capsules for bacterial vaginosis and other vaginal infections: a double-blind, randomized, placebo-controlled study", 2013, pp. 75-79, vol. 168, European Journal of Obstetrics Gynecology and Reproductive Biology.
Morgavi, et al., "Rumen microbial communities influence metabolic phenotypes in lambs", Oct. 2015, pp. 1-13, vol. 6, Frontiers in Microbiology.
Brugere, et al., "Archaebiotics", Oct. 14, 2016, pp. 5-10, vol. 5, No. 1, Gut Microbes.

\* cited by examiner

USE OF MICROORGANISMS FOR REDUCING THE LEVEL OF TRIMETHYLAMINE IN A HUMAN BODY CAVITY, IN PARTICULAR FOR THE TREATMENT OF TRIMETHYLAMINURIA OR OF BACTERIAL VAGINOSIS AND THE PREVENTION OF CARDIOVASCULAR DISEASES

STATEMENT REGARDING SEQUENCE LISTING

The Sequence Listing associated with this application is provided in text format in lieu of a paper copy, and is hereby incorporated by reference into the specification. The name of the text file containing the Sequence Listing is "P11311US00SeqListing revised110215.txt." The size of the text file is 2.09MB (2,195,578 bytes), it was created on Nov. 2, 2015, and is being submitted electronically via EFS-Web.

The present invention relates to the use of microorganisms allowing metabolism of trimethylamine (TMA) in at least one human body cavity ("human cavity" hereafter) comprising microbial flora able to produce TMA and therefore reducing the level of this TMA at the human cavity.

The invention relates to the use of these microorganisms in the intestine in order to reduce the intestinal level of this TMA. The goal of the invention is notably to allow treatment of trimethylaminuria and/or reduce the trimethylamine N-oxide (TMAO) level, which gives the possibility of preventing the formation of atheromatous plaques and of providing an additional means for preventing cardiovascular diseases.

The invention also relates to the delivery in situ of enzymes allowing metabolism of TMA.

Trimethylaminuria (or TMAU, a uremia with TMA, or fish-odor syndrome) is a genetic disease in which a person genetically deficient in an enzyme (flavine containing monooxygenase 3 FMO3) cannot effectively transform TMA into TMAO at the liver. Also in certain cases, the deficiency in this capability of transformation is sporadic and acquired. Trimethylamine then accumulates in the body and is finally removed through sweat, urine and exhalation, with a strong fish smell. If no actual study shows the general incidence of the disease, the figure of 1% of the American population has however been put forward. In the following, such a person will be designated as a TMA-metabolism deficient patient.

Intestinal TMA has a food origin and notably results from the conversion of TMAO, choline or lecithin brought by food (notably eggs, meat, liver, wheat germ, fish, etc.). These compounds are transformed at the intestine by intestinal microbiota.

Moreover, in persons having the active FMO3 enzyme, the TMA is transformed into TMAO in the liver and this metabolite is again found in the blood flow. Wang et al. (Nature 2011, 472 (7341), 57-63; see also K Rak and D J Rader, Cardiovascular Disease, News and Views, Nature 2011, 472, 40-41) teach that circulating TMAOs may contribute to the development of atheromatous plaques in the arteries and therefore to heart diseases.

Bacterial vaginosis is a benign disease in women, the cause of which is an imbalance of the vaginal microbial flora. This imbalance would stem from depletion of lactobacillar flora in favor of increase in an anaerobic flora notably comprising *Gardnerella vaginalis*. Bacterial vaginosis is characterized by greyish and fragrant vaginal losses or fluids. The smell of these vaginal losses or fluids is due to the presence of TMA (Wolrath et al. APMIS 2002, 110, 819-824; also see Wolrath et al. APMIS 2005, 113, 513-516).

The invention also relates to the use of these microorganisms in the vagina in order to reduce the level of TMA in vaginal fluids. The object of the invention is notably to allow treatment of vaginal fluids in the case of bacterial vaginosis or of any disorder or disease causing a local production of TMA, which gives the possibility of reducing the strong smells of vaginal losses or vaginal fluids.

The object of the invention is also a novel microorganism which may be used in these applications.

Methanogenic Archaea are microorganisms which produce methane under anaerobic conditions. Certain Archaea are found in the digestive system of animals such as ruminants, as well as in certain human individuals, in particular elderly individuals.

Thus, the team of B. Dridi (International Journal of Systematic Evolutionary Microbiology 2012, 62, 1902-1907) presents the isolation of such a microorganism with the name of Methanomassiliicoccus luminyensis for which it is described that under an atmosphere with $H_2$, this Archaea may reduce methanol to methane. It is also described that this microorganism is incapable of methanogenesis from trimethylamine, as well as from other substrates, under a $CO_2$ atmosphere. The complete genome of this Archaea was published and mentioned in A. Gorlas, Journal of Bacteriology, September 2012, Vol. 194, 17, p. 4745, the genome being accessible in GenBank under the access references CAJE01000001 to CAJE01000026.

At the present time, notably in humans, no microorganisms, notably Archaea, have been described as able to use and metabolize TMA in vivo.

The inventors managed to identify a novel species of methanogenic Archaea in a sample of salts from a human individual, a species comprising a gene coding for a TMA methyltransferase (gene mttB) and a gene coding for a corrinoid protein accepting a methyl group from TMA (gene mttC), capable, in the presence of hydrogen and under anaerobic conditions encountered in certain organs or cavities which they delimit, such as the intestine, the human colon or the vagina, of metabolizing TMA, so that the proposal here is to use these microorganisms for metabolizing TMA for reducing its level, notably the intestinal or vaginal level. It was further discovered that this strain of Archaea also has a gene of resistance to biliary salts, notably a gene coding for hydrolysis of biliary salts, thereby promoting survival and maintaining of the microorganism at the intestine level. This microorganism is designated hereafter as strain 1 or Methanomethylophilus alvus. The inventors have also identified that the strain of Archaea Methanomassiliicoccus luminyensis described by D. Didri et al. (supra), sometimes designated hereafter strain 2, also has genes coding for TMA methyltransferase and for a corrinoid protein accepting a methyl group from TMA able to allow metabolism of TMA in the presence of hydrogen in the intestine. It is believed that TMA is metabolized with formation of methylated proteins (methylated corrinoid proteins) which capture the methyls of TMA. This methylated protein is then no doubt driven into the route of methanogenesis, resulting in the production of methane.

By definition, one will equally refer here to an organ delimiting a cavity or to the cavity itself, which may contain anaerobic microbial flora able to produce or producing TMA. It is also possible to define this organ or cavity as an organ or cavity containing TMA produced by microbial flora. This TMA production is generally obtained in the presence of a hydrogen source stemming from microbial metabolism.

The object of the invention is therefore a composition containing a microorganism expressing a TMA methyltransferase. The microorganism is capable of metabolizing trimethylamine (TMA) in the presence of hydrogen in a human organ or cavity according to the definition supra. The composition may be used as a drug for treating, reducing or suppressing TMA at the human organ or cavity, and/or treating any pathology, inconvenience or disorder characterized by the presence of TMA or derived from the presence of TMA.

A composition according to the invention contains a microorganism expressing TMA methyltransferase, capable of metabolizing trimethylamine (TMA) in the presence of hydrogen in at least one human cavity comprising microbial flora able to produce TMA, for use as a drug for treating, reducing or suppressing TMA at the human cavity.

According to a first aspect, the invention relates to a composition containing a microorganism expressing a TMA methyltransferase, capable of metabolizing trimethylamine (TMA) in the presence of hydrogen in the intestine, for use as a drug for reducing or suppressing TMA at the intestine level and/or in the liver.

More specifically, in a first embodiment, the use aims at treating trimethylaminuria. The treated patient has a deficiency in the capacity of metabolizing TMA. Notably, he/she is deficient in an active FMO3 enzyme.

In a second embodiment, the use aims at reducing the hepatic metabolite level of TMA, TMAO, notably plasma TMAO. This use may aim at preventing the formation of atheromatous plaques and/or preventing cardiovascular diseases. The targeted patient is either a patient capable of metabolizing TMA, or a patient with TMA-metabolism deficiency but treated with a drug allowing reestablishment of TMA metabolism into TMAO. The metabolization of TMA upstream, for example with the composition according to the invention, then allows limitation of the production of TMAO by the liver.

The use of the composition according to the invention in a TMA-metabolism deficient patient gives the possibility of combining both effects, metabolism of TMA or treatment of trimethylaminuria and reduction of plasma TMAO, prevention of the formation of atheromatous plaques and/or prevention of cardiovascular diseases.

The object of the invention is also a composition containing a microorganism expressing TMA methyltransferase, capable of metabolizing trimethylamine (TMA) in the presence of hydrogen in the intestine, for treating trimethylaminuria.

The object of the invention is therefore also a composition containing a microorganism expressing a TMA methyltransferase, capable of metabolizing trimethylamine (TMA) in the presence of hydrogen in the intestine, for use as a drug for reducing the plasma TMAO level, preventing the formation of atheromatous plaques and/or preventing cardiovascular diseases.

According to a second aspect, the invention relates to a composition containing a microorganism expressing TMA methyltransferase, capable of metabolizing trimethylamine (TMA) in the presence of hydrogen in the vagina, in order to treat, reduce or suppress the TMA present in the vagina or the vaginal fluids.

In particular, without intending to be bound by theory, it is believed that TMA present in the vagina or the vaginal fluids results from the conversion of compounds, comprising a nitrogen-containing group substituted with three methyls, by the vaginal microbial flora.

In an embodiment, the use aims at treating vaginal fluids in the case of bacterial vaginosis and at reducing or suppressing the smells due to the presence of TMA.

In order to ensure metabolization of TMA by the microorganisms according to the invention, it is preferable that the methyls of the TMA be transferred to another molecule.

In an embodiment, the microorganism also expresses a corrinoid protein able to play this role of methyl acceptor. This protein is in particular a corrinoid protein accepting a methyl group from TMA.

In an embodiment, the composition comprises a microorganism comprising the gene coding for a TMA methyltransferase having the sequence SEQ ID NO: 1 or 2, or an equivalent sequence (of a methyltransferase active on TMA) having more than 90% of identity, notably having 90, 91, 92, 93, 94, 95, 96, 97, 98 or 99% of identity, with SEQ ID NO: 1 or 2.

In an embodiment, the composition comprises a microorganism comprising the gene coding for a TMA methyltransferase, this gene having the sequence SEQ ID NO: 3 or 4, or an equivalent sequence (sequence coding for a methyltransferase active on TMA) having more than 90% of identity, notably having 90, 91, 92, 93, 94, 95, 96, 97, 98 or 99% of identity, with SEQ ID NO: 3 or 4.

In an embodiment, the composition comprises a microorganism comprising the gene coding for a corrinoid protein accepting a methyl group from TMA, having the sequence SEQ ID NO: 5 or 6, or an equivalent sequence (of a corrinoid protein accepting a methyl group capable of capturing the methyls of TMA in the presence of a methyltransferase) having more than 90% of identity, notably having 90, 91, 92, 93, 94, 95, 96, 97, 98 or 99% of identity, with SEQ ID NO: 5 or 6.

In an embodiment, the composition comprises a microorganism comprising the gene coding for a corrinoid protein accepting a methyl group from TMA, this gene having the sequence SEQ ID NO: 7 or 8, or an equivalent sequence (sequence coding for a corrinoid protein accepting a methyl group capable of capturing the methyls of TMA in the presence of a methyltransferase) having more than 90% of identity, notably having 90, 91, 92, 93, 94, 95, 96, 97, 98 or 99% of identity, with SEQ ID NO: 7 or 8.

In an embodiment, the composition comprises a microorganism comprising the gene coding for a TMA methyltransferase having the sequence SEQ ID NO: 1, or an equivalent sequence as defined supra, and the gene coding for a corrinoid protein accepting a methyl group from TMA, having the sequence SEQ ID NO: 5, or an equivalent sequence as defined supra.

In an embodiment, the composition comprises a microorganism comprising the gene coding for a TMA methyltransferase having the sequence SEQ ID NO: 2, or an equivalent sequence as defined supra, and the gene coding for a corrinoid protein accepting a methyl group from TMA, having the sequence SEQ ID NO: 6, or an equivalent sequence as defined supra.

In an embodiment, the composition comprises a microorganism comprising the gene coding for a TMA methyltransferase, this gene having the sequence SEQ ID NO: 3, or an equivalent sequence as defined supra, and the gene coding for a corrinoid protein accepting a methyl group from TMA, this gene having the sequence SEQ ID NO: 7, or an equivalent sequence as defined supra.

In an embodiment, the composition comprises a microorganism comprising the gene coding for a TMA methyltransferase, this gene having the sequence SEQ ID NO: 4, or an equivalent sequence as defined supra, and the gene coding for a corrinoid protein accepting a methyl group from TMA, this gene having the sequence SEQ ID NO: 8, or an equivalent sequence as defined supra.

In an embodiment, the microorganism also includes a gene for resistance to biliary salts, preferably a gene coding for a hydrolase of biliary salts, such as choloylglycine hydrolase.

In an embodiment, the choloylglycine hydrolase has the sequence SEQ ID NO: 9, or an equivalent sequence (of an hydrolase active on biliary salts) having more than 90% of identity, notably having 90, 91, 92, 93, 94, 95, 96, 97, 98 or 99% of identity, with SEQ ID NO: 9. In an embodiment, the choloylglycine hydrolase is coded by a gene having the sequence SEQ ID NO: 10, or an equivalent sequence (sequence coding for an hydrolase active on biliary salts) having more than 90% of identity, notably having 90, 91, 92, 93, 94, 95, 96, 97, 98 or 99% of identity, with SEQ ID NO: 10.

In an embodiment, the composition comprises a microorganism comprising the gene coding for a TMA methyltransferase having the sequence SEQ ID NO: 1, or an equivalent sequence as defined supra, the gene coding for a corrinoid protein accepting a methyl group from TMA having the sequence SEQ ID NO: 5, or an equivalent sequence as defined supra, and the gene coding for a choloylglycine hydrolase having the sequence SEQ ID NO: 9, or an equivalent sequence as defined supra.

In an embodiment, the composition comprises a microorganism comprising the gene coding for a TMA methyltransferase, this gene having the sequence SEQ ID NO: 3, or an equivalent sequence as defined supra, the gene coding for a corrinoid protein accepting a methyl group from TMA, this gene having the sequence SEQ ID NO: 7, or an equivalent sequence as defined supra, and the gene coding for a choloylglycine hydrolase, this gene having the sequence SEQ ID NO: 10, or an equivalent sequence as defined supra.

According to a preferred embodiment, in these compositions, the microorganism is a methanogenic Archaea, notably of human or animal origin, preferably human origin.

In an embodiment, the microorganism is a methanogenic Archaea for which the RNA 16S is coded by the DNA sequence SEQ ID NO: 11 (strain 1 identified by the inventors) or a sequence having more than 85%, notably more than 90% of identity, notably having 90, 91, 92, 93, 94, 95, 96, 97, 98 or 99% of identity, with SEQ ID NO. 11. This microorganism comprises the gene coding for a TMA methyltransferase having the sequence SEQ ID NO: 1, or an equivalent sequence as defined supra, the gene coding for a corrinoid protein accepting a methyl group from TMA, having the sequence SEQ ID NO: 5, or an equivalent sequence as defined supra, and the gene coding for a choloylglycine hydrolase, having the sequence SEQ ID NO: 9, or an equivalent sequence as defined supra. This microorganism comprises the gene coding for a TMA methyltransferase, this gene having the sequence SEQ ID NO: 3, or an equivalent sequence as defined supra, the gene coding for a corrinoid protein accepting a methyl group from TMA, this gene having the sequence SEQ ID NO: 7, or an equivalent sequence as defined supra, and the gene coding for a choloylglycine hydrolase, this gene having the sequence SEQ ID NO: 10, or an equivalent sequence as defined supra. The genome of this strain, designated here as Methanomethylophilus alvus, is shown in SEQ ID NO: 13.

In an embodiment, the microorganism is a methanogenic Archaea for which the RNA 16S is coded by the DNA sequence SEQ ID NO: 12 (strain 2 described by Dridi supra, strain DSM No. 25720; or CSUR P135), or a sequence having more than 85%, preferably more than 90% of identity, notably having 90, 91, 92, 93, 94, 95, 96, 97, 98 or 99% of identity, with SEQ ID NO. 12. This microorganism comprises the gene coding for a TMA methyltransferase having the sequence SEQ ID NO: 2, or an equivalent sequence as defined supra, and the gene coding for a corrinoid protein accepting a methyl group from TMA, having the sequence SEQ ID NO: 6, or an equivalent sequence as defined supra. This microorganism comprises the gene coding for a TMA methyltransferase, this gene having the sequence SEQ ID NO: 4, or an equivalent sequence as defined supra, and the gene coding for a corrinoid protein accepting a methyl group from TMA, this gene having the sequence SEQ ID NO: 8, or an equivalent sequence as defined supra. In an embodiment, the composition comprises the strain Methanomassiliicoccus luminyensis DSM No. 25720, available at the DSMZ collection (Inhoffenstraße 7B, 38124 Braunschweig (Brunswick), Germany).

An alternative means for reduction in situ of TMA is the use of genetically modified organisms, in particular recombinant bacteria. In order to be effective, these bacteria should both express a gene coding for the protein MttB (allowing demethylation of TMA) and for the protein MttC (corrinoid protein, accepting a methyl group taken from TMA by MttB). The expression of an active MttB protein requires that the latter have pyrrolysine in its inside. For this purpose, the recombinant organism should also be (i) capable of synthesizing pyrrolysine and (ii) of incorporating this amino acid during translation of the recombinant protein MttB, which may be achieved by incorporating a dedicated cassette for expanding the genetic code. Thus, the genetically modified organism contains:

- The gene or portion of the gene mttC (for example SEQ ID NO: 7 or 8) coding for a corrinoid protein (for example SEQ ID NO:5 or 6).
- The gene or portion of the gene mttB (for example SEQ ID NO: 3 or 4), coding for the MttB protein (for example SEQ ID NO: 1 or 2). This gene or gene portion present in its coding portion has an intermediate interruption of the reading frame by a stop codon (ideally a UGA (amber) codon as exhibited by the natural case described here in strains 1 and 2 (Methanomassiliicoccus luminyensis and "Ca. methanomethylophilus alvus")
- The genes allow synthesis of pyrrolysine: these genes are borne by the operon pyl, and more particularly relate to the genes pylB, pylC and pylD (mentioned as pylBCD) respectively coding for a lysine mutase/proline-2 methylase, a pyrrolysine synthetase and a proline reductase/pyrrolysine synthase. These coded enzymes allow synthesis of pyrrolysine from two lysines.
- The gene coding for a transfer RNA suppressor of the stop codon used (ideally, a tRNA suppressor of the UGA amber codon, i.e. a tRNA having the anticodon TCA). Ideally, this gene is that of one of the described microorganisms (Methanomassiliicoccus luminyensis and "Ca. Methanomethylophilus alvus"), designated as pylT.
- The gene coding for an amino-acyl tRNA synthetase, allowing grafting of the proper amino acid on the corresponding tRNA: in this case, a pyrrolysine tRNA synthetase has to be used, coded by the gene pylS.

As a microorganism, it is possible to use Escherichia coli. The recombinant E. coli strain comprises the genes mttB, mttC, pylBCD, pylT and pylS. The strain thus expresses the proteins required for synthesizing pyrrolysine. This pyrrolysine is grafted to a specific tRNA (Pyl amber tRNA, coded by pylT) by the action of pyrrolysine-tRNA synthetase. An example of this type of modified organism was moreover described (Longstaff et al, 2007, PNAS 104 (3), pp 1021-1026: "a natural genetic code expansion cassette enables transmissible biosynthesis and genetic encoding of pyrrolysine"; Namy et al., 2007, FEBS letters 581 (27), pp 5285-

5288: "Adding pyrrolysine to the *Escherichia coli* genetic code") and such a strain is viable: it incorporates a pyrrolysine in these proteins as soon as the mRNA contains an amber stop codon in the reading phase.)

This recombinant *E. coli* also expresses the gene mttB, interrupted inside it by an amber stop codon in the reading phase (case of *Archean* genes mttB). This codon is thus recognized by such a recombinant strain as a amber-Pyl codon and gives the possibility of obtaining a protein containing inside it a pyrrolysine, which is enzymatically active. This method mimics what is naturally achieved by methylotrophic methanogenic microorganisms such as for example Methanosarcinales. Further, this method proved to be effective for the gene mtmB1 of *Methanosarcina acetivorans*, containing an internal amber codon, coding for pyrrolysine: The protein coded by mtmB1 (monomethylamine methyltransferase), expressed in an *E. coli* strain expressing pylBCD, pylS, and pylT then contains a pyrrolysine (Longstaff et al, op. cit.; Namy et al, op. cit.). This method may be used in the same way for MttB. The latter, synthesized in a form containing pyrrolysine, may then demethylate TMA into dimethylamine (DMA), by transferring this methyl to an acceptor protein (a corrinoid protein coded by mttC), thereby reducing the TMA concentration.

As another microorganism, it is possible to use a *Lactobacillus*. *Lactobacillus* strains may be used according to the same principles as described for *E. coli*, by using vectors and techniques for bacterial transformation specific to these Gram-positive bacteria (see for example Berthier et al., 1996, Microbiology, 142, pp 1273-1279 or Alegre et al., 2006, FEMS Microbiology Letters, 241 (1), pp 73-77). In this framework, one has a genetically modified organism directly derived from natural commensal hosts of the human intestine and of the vagina, and for some of them, they may also exhibit probiotic initial activities.

In an embodiment, the natural or recombinant microorganisms of the invention are live microorganisms.

In other embodiments, they may be killed or inactivated.

The compositions according to the invention may further comprise a pharmaceutically acceptable carrier or excipient.

In an embodiment, the composition is a culture extract, preferably a concentrated extract. Notably, a concentrated extract of a live microorganism is used.

In an embodiment, the composition or an extract used as an active ingredient in the composition comprises a population of microorganisms essentially consisting or exclusively consisting in methanogenic microorganisms according to the invention. The composition may comprise one species or one single strain of them, or else comprise at least two different species or strains of them.

In another embodiment, the composition or an extract used as an active ingredient in the composition comprises a population of microorganisms comprising at least one species or one strain of a methanogenic microorganism according to the invention, and one or several other microorganisms, notably stemming from cultivation. The composition may comprise a species or a single strain of a methanogenic microorganism according to the invention, or else comprise at least two different species or strains of them.

In an embodiment, the microorganisms are freeze-dried. Freeze-drying is achieved by a standard technique. The composition may then comprise an excipient and/or a standard freeze-drying stabilizer, or any other useful additive.

The invention also relates to another alternative means for trapping and reducing the TMA concentration at the desired sites, based on delivery in situ of at least the active enzyme MttB and of the protein accepting a methyl group MttC. This may be based on two distinct principles:

On the one hand, the purification of these proteins from microorganisms naturally producing MttB and MttC, such as for example the methanogenic Archaea of the order of Methanosarcinales or methanogens related with Thermoplasmatales, such as M. luminyensis or Ca. M. alvus, which may be cultivated in vitro. These may also be other microorganisms of the bacterial type naturally coding for pyrrolysine, a MttB containing a pyrrolysine and an MttC, which may be cultivated in vitro: for example, the bacteria *Acetohalobium arabaticum, Desulfitobacterium hafniense, D. dehalogenans* or *Bilophila wadsworthia*. A list of these microorganisms known to this day is referenced by Prat et al., 2012, PNAS, 109 (51), pp 1070-1075 and additional documents appended to this publication.

On the other hand, the purification of these proteins from recombinant microorganisms. This production/purification may also be facilitated by using systems for producing and secreting heterologous proteins. This may then be carried out in a microorganism such as those described above (*E. coli* or *Lactobacillus*), so as to have a joint production of pyrrolysine, systems allowing its incorporation at amber codons and the expression of a protein MttB containing a pyrrolysine. Moreover, the production of the protein MttC may be carried out in parallel in another organism.

A combined solution of the two, in order to obtain an active MttB protein containing pyrrolysine on the one hand, and the corrinoid protein MttC on the other hand.

The invention therefore relates to a composition comprising a TMA methyltransferase, notably a MttB protein, preferably an MttB protein having the sequence SEQ ID NO: 1 or 2 or an equivalent sequence (of a methyltransferase active on TMA) having more than 90% of identity, notably having 90, 91, 92, 93, 94, 95, 96, 97, 98 or 99% of identity, with SEQ ID NO: 1 or 2.

The invention also relates to a corrinoid protein accepting a methyl group from TMA, having the sequence SEQ ID NO: 5 or 6, or an equivalent sequence (of a corrinoid protein accepting a methyl group capable of capturing the methyls of TMA in the presence of a methyltransferase) having more than 90% of identity, notably having 90, 91, 92, 93, 94, 95, 96, 97, 98 or 99% of identity, with SEQ ID NO: 5 or 6.

Alternatively, the same composition comprises both of these proteins.

Still alternatively, the composition is in the form of a kit comprising both compositions, for separate, simultaneous or sequential administration.

The obtained proteins may therefore be associated with an adequate galenic system allowing, depending on the selected target, intestinal delivery (vectors allowing for gastro-resistance), rectal or vaginal delivery. Delivered in situ, the active MttB protein allows conversion of the TMA into DMA by demethylation of a group, this methyl group may then be transferred to the MttC protein. This regenerates the MttB protein for another demethylation of TMA and results in the reduction of the amount of TMA.

The compositions of the invention also appear in a form adapted to the cavity or organ to be treated. They comprise a suitable carrier or excipient and/or are associated with or included in a galenic form adapted to the administration route.

In an embodiment, the composition preferably appears as an administration form via an oral route.

For the intestine notably, this oral form may advantageously comprise an enteric administration form, notably an enteric capsule, an enteric gelatin capsule, a tablet including an enteric coating, an encapsulation, for example microencapsulation, with a material providing enteric protection, the combination of at least two of these means for which at least one provides enteric protection, etc. The term of enteric means that the administration form protects the composition until it attains the intestine. For example, the composition, notably the lyophilisate of microorganisms, may be coated with a coating by means of protective agents, notably selected as usual from proteins, polysaccharides, gums and other enteric coating agents. In an embodiment, a double coating is achieved according to the teaching of EP 1 514 553.

The administration form may also be adapted to direct administration in a cavity of the body such as the vagina, for example in the form of ovules.

The administration form may also be adapted to administration via a rectal route, for example as a suppository or the like.

In this embodiment, the compositions according to the invention contain from 10 to $10^{13}$ microorganisms.

The object of the present invention is also a treatment method intended to reduce the TMA level in a patient in need thereof.

The object of the invention is therefore a method for reducing or suppressing TMA at a cavity or at a human organ, notably at the intestine, vagina level and/or in the liver, comprising the administration to a patient in need thereof, of a sufficient amount of a composition according to the invention, containing a microorganism expressing a TMA methyltransferase or such an enzyme. This microorganism, by expression of the enzyme or the directly administered enzyme is capable of metabolizing trimethylamine (TMA) in the presence of hydrogen in the cavity, notably the intestine or the vagina. Preferably, the microorganism also expresses a corrinoid protein accepting a methyl group from TMA, or further this protein is also administered. Still preferably, the microorganism also expresses a hydrolase of biliary salts, notably a choloylglycine hydrolase. In an embodiment, the composition comprises a methanogenic Archaea, notably Methanomethylophilus alvus or Methanomassiliicoccus luminyensis.

In a first embodiment, the invention relates to a method for treating trimethylaminuria. The treated patient has a deficiency in the capability of metabolizing TMA. Notably, he/she is deficient in an active FMO3 enzyme.

In a second embodiment, the invention relates to a method allowing reduction in the level of the hepatic metabolite of TMA, TMAO, notably plasma TMAO. This method may aim at preventing the formation of atheromatous plaques and/or preventing cardiovascular diseases. The targeted patient is either a patient capable of metabolizing TMA, or a TMA-metabolism deficient patient but treated with a drug allowing reestablishment of metabolism of TMA into TMAO, for example with the composition according to the invention. Metabolization of the TMA upstream then allows limitation of the TMAO production by the liver.

The method applied in a TMA-metabolism deficient patient allows a combination of both effects, metabolism of TMA or treatment of trimethylaminuria, and reduction of plasma TMAO, prevention of the formation of atheromatous plaques and/or prevention of cardiovascular diseases.

In a third embodiment, the invention relates to a method for treating vaginal fluids in the case of bacterial vaginosis. The method notably aims at reducing or suppressing TMA and/or the smells associated with the presence of TMA.

In a preferred embodiment, the microorganisms are live microorganisms.

In an embodiment, at least one dose containing a sufficient amount of microorganisms or of enzyme in order to obtain the sought effect from between reduction of the TMA level, reduction of the TMAO level or further a combination of both, is administered to the patient. Additional doses may be administered spread out in time, notably at regular time intervals, for example at each meal, in order to maintain the sought effect.

In another embodiment in which the microorganism is necessarily live, either at least one dose immediately efficient for obtaining the sought effect from between reduction of the TMA level, reduction of the TMAO level, or further a combination of both, or a sowing dose, is administered to the patient, the intraintestinal or intravaginal development of the microorganism then giving the possibility of obtaining the sought effect.

In an embodiment, the microorganism is implanted into the intestine in the long run. It is then possible to contemplate one or several (e.g. from one to five) initial doses, for example taken during meals, and then supplements at regular time intervals, or after episodes of intestinal disorder (diarrhoeas or other disorders).

In another embodiment, the microorganism is implanted in the vagina in the long run. It is then possible to contemplate one or several (e.g. from one to five) initial doses, for example taken upon waking up and/or going to sleep, and then supplements at regular time intervals, or after episodes of significant fragrant vaginal losses.

In an embodiment, the administration of microorganisms according to the invention and of the enzyme and/or of the acceptor protein are associated.

The compositions used in these treatment methods may have different developed characteristics supra.

The object of the present invention is also a culture containing a methanogenic Archaea for which the RNA 16S is coded by the DNA sequence SEQ ID NO: 11 (strain 1 identified by the inventors) or a sequence having more than 90% of identity, notably having 90, 91, 92, 93, 94, 95, 96, 97, 98 or 99% of identity, with SEQ ID NO: 11. This microorganism comprises the gene coding for a TMA methyltransferase having the sequence SEQ ID NO: 1, or an equivalent sequence as defined supra, the gene coding for a corrinoid protein accepting a methyl group from TMA, having the sequence SEQ ID NO: 5, or an equivalent sequence as defined supra, and the gene coding for a choloylglycine hydrolase, having the sequence SEQ ID NO: 9, or an equivalent sequence as defined supra. This microorganism comprises the gene coding for a TMA methyltransferase, this gene having the sequence SEQ ID NO: 3, or an equivalent sequence as defined supra, the gene coding for a corrinoid protein accepting a methyl group from TMA, this gene having the sequence SEQ ID NO: 7, or an equivalent sequence as defined supra, and the gene coding for a choloylglycine hydrolase, this gene having the sequence SEQ ID NO: 10, or an equivalent sequence as defined supra. The genome of this strain, designated here as Methanomethylophilus alvus, is shown in SEQ ID NO: 13.

The culture may correspond to a consortium of microorganisms, for example stemming from cultivation of stools of a human patient or of an animal, inter alia containing Methanomethylophilus alvus, and preferably this microorganism represents more than 10%, preferably more than 20, 30, 40, 50, 60, 70, 80, 90% of the microorganisms in the consortium. Notably, this microorganism represents in the consortium, more than 10%, preferably more than 20, 30, 40, 50, 60, 70, 80, 90% of the methanogenic strains the most frequently encountered in humans (Methanobacteriales of the *Methanobrevibacter smithii* and *Methanosphaera stadtmanae* type).

The culture may also be a pure culture of Methanomethylophilus alvus.

The culture comprises a suitable carrier. The culture is maintained under anaerobic conditions.

List of sequences:

| SEQ ID NO: | Amino acids | Nucleotides |
|---|---|---|
| 1 | TMA methyltransferase strain 1 | |
| 2 | TMA methyltransferase strain 2 | |

| SEQ ID NO: | Amino acids | Nucleotides |
|---|---|---|
| 3 | | mttB gene coding for TMA methyltransferase strain 1 |
| 4 | | mttB gene coding for TMA methyltransferase strain 2 |
| 5 | Corrinoid protein accepting a methyl group from TMA strain 1 | |
| 6 | Corrinoid protein accepting a methyl group from TMA strain 2 | |
| 7 | | mttC gene coding for the corrinoid protein accepting a methyl group from TMA strain 1 |
| 8 | | mttC gene coding for the corrinoid protein accepting a methyl group from TMA strain 2 |
| 9 | Hydrolase of biliary salt strain 1 | |
| 10 | | Gene coding for hydrolase of biliary salts strain 1 |
| 11 | | DNA coding for the RNA 16S strain 1 |
| 12 | | DNA coding for the RNA 16S strain 2 |
| 13 | | Genome of strain 1 |
| 14 | | mttb Fw primer |
| 15 | | mttb Rv primer |
| 16-21 | | Primers |

The invention will now be described in more detail by means of non-limiting application examples.

EXAMPLE 1

Method for Isolating and Cultivating a Methanogenic Archaea Consuming TMA 1.1. Molecular Detection Method:

Molecular biology methods give the possibility of detecting and distinguishing methanogenic Archaea consuming TMA (called here Methanomethylophilales) between them. A first phase may consist of detecting methanogenic Archaea by means of the RNA 16S by taking the RNAs 16S of the strains 1 and 2 described supra, or DNAs coding for these RNAs 16S, by means of suitable primers. A second phase (or first phase if the classification has already been achieved) consists of detecting the presence of an mttb (or mttB) gene, and optionally further a mttc (or mttC) gene. Primers which may be used for detecting the mttb gene are the following:

```
Fw: SEQ ID NO: 14:    GCACTTCCACCACATCG

Rv: SEQ ID NO: 15:    AGCTGRGACAGRACGAT
``` wherein R corresponds to a puric base, A or G
Amplicon: 270-300 bp.

1.2. Cultivation, Enrichment and Isolation Method

Cultivation/isolation is initially achieved from fresh stools, from a human: this human may be a person in which the presence of methanogens in general and of Methanomethylophilales in particular will have been detected with molecular detection techniques mentioned above (from DNAs extracted from these stools, according to standard methodologies with the QIAGen DNA Stool Kit). Alternatively, the detection of the presence of Methanomethylophilales may be achieved in parallel with the cultivation, according to the same methodology.

All the manipulations are performed under sterile and strictly anaerobic conditions ($N_2$ flow). The stools, once recovered are immediately treated. Otherwise, alternatively, their preservation may be achieved before use, for several hours at 4° C., in a closed jar, in which anaerobic conditions have been initiated, without any apparent dramatic modification on the results and the survival of the methanogens in the sample.

About 500 to 600 mg of stools are recovered by means of a 1 ml insulin syringe, the end of which is cut (i.e. about 0.4 ml). They are placed in 10 ml of the medium 141 DSMZ (methanogenium medium) specific for methanogenic microorganisms, in a $H_2/CO_2$ atmosphere (80/20, pressure of 2 atm) or in an $N_2$ atmosphere (initially 100%, pressure of 2 atm) in an antibiotic vial of 60 ml.

In order to promote development of Methanomethylophilales, and thus enrich the culture in the consortium, in the tube are further put:

a specific substrate of this group=methanol (final 80 mM), or alternatively, one of its natural <<sources>> in the human colon, i.e. pectin which will be hydrolyzed by other microbes of the consortium (and potentially Methanomethylophilales) so as to obtain methanol inter alia.

Various antibiotics such as bacitracin or metronidazole, (100 mg/l); Dridi et al. (supra) have proposed various antibiotics to which Methanomassiliicoccus luminyensis is resistant (bacitracin, metronidazole, ordinazole, squalamine).

This cultivation is then carried out at 37° C. with slight stirring, the tracking of the cultivation is continuously ensured by quantitative PCR, preferably daily. Depending on the types of strains of Methanomethylophilales, various duplication times are observed, and may vary by one to three times, or even more. As an example, the scenario encountered with stools of a patient bearing Methanomethylophilus alvus is illustrated, from the inoculation of a stool sample. This is a patient having $10^6$ as a number of copies of 16S rRNA genes/ml of *Methanobrevibacter smithii* (Mbs) culture, 10 times more than M. alvus (Mx), and even 10 times more bacteria (stools at the beginning of cultivation, time 0). During the first days of a culture in a standard medium, without providing pectin or methanol, the Mbs and certain bacteria develop much faster and supplant Mx, before stabilization and retarded development of Mx, at levels approaching the initial amount in the sample. This level may be improved by adding methanol, or even pectin, a substrate generating methanol, like in the case at day 20: a sharp improvement in the proportion of Mx is then observed over time relatively to the bacteria and to Mbs. This method may be repeated: during the monitoring (preferably daily monitoring), it is then possible to determine the best time for transplanting the consortium or simply re-supplementing the culture with methanol/pectin (for example on a plateau phase observed from day 20). After a certain number of enrichment cycles, it is possible to achieve isolations of an Mx strain from this mixture, by individualized cultivations of a clone of this liquid medium in consortium. This is carried out by the method of roll-tubes, a method which under anaerobic conditions gives the possibility of obtaining isolated colonies in a DSMZ 141+agar solid medium, in the presence of methanol (anaerobic atmosphere, containing at least $H_2$). In this solid medium culture, the first colonies which appear (1$^{st}$ week) are not the sought Mx. The small colonies which appear subsequently (notably after 2 or 3 weeks of cultivation), are recovered and are used for inoculating individually, colony by colony, tubes with DSMZ-141 medium. In parallel, by quantitative PCR, it is determined whether the transplanted colony is an Mx or not. In the positive case, the isolation is then achieved, the culture is transplanted according to the Mx growth rate in a liquid medium 141 supplemented with methanol, under a H$_2$/CO$_2$ atmosphere. The purity of the isolated strain may then be checked, either by reproducing a second time the method described above (isolated colonies in a solid medium according to the technique of roll-tubes), or by analyzing the dissociation curves obtained on amplicons of quantitative PCRs, or further by sequencing the amplicon 16S.

1.3. Procedure for Fast Quantification of Cultivated Procaryotic Lines

This procedure is used for following in parallel Methanomethylophilales or Mmp (Mx=M. alvus, M. luminyensis, other species), Methanobacteriales (Mbac, such as *Methanobrevibacter smithii* or *Methanosphaera stadtmanae*) and total bacteria (Bac) in enrichment cultures in order to define the best conditions for the growth of M. alvus.

Principle:

Lysis of a small culture aliquot (0.1 to 0.2 ml) at a high temperature+osmotic shock.

Reduction of the concentration of PCR inhibitors by centrifugation and dilution of the supernatant.

Quantification of the groups of interest in qPCR

The quantification calibration ranges are prepared beforehand and consist in PCR amplicons, made with the primers described, purified and quantified according to standard methods.

Equipment:
Centrifuge (set to 4° C.)
Thermomixer (set to 99° C.)
Thermocycler
Mmp, Mbac and Bac primers:

```
MxF (AS-05_Fw; 77):
ggg gTA ggg gTA AAA TCC TG      (SEQ ID NO: 16)

MxR (AS-06_Rv; 78):
Cgg ggT ATC TAA TCC CgT TT      (SEQ ID NO: 17)

MbacF (MbS-01_Fw; 75):
gCg AAC Cgg ATT AgA TAC CC      (SEQ ID NO: 18)

MbacR (MbS-02_Rv; 76):
AgT CTT gCg ACC gTA CTT CC      (SEQ ID NO: 19)

BacF (ES-06_Fw; 71):
ACT CCT ACg ggA ggC Ag          (SEQ ID NO: 20)

BacR (ES-07_Rv; 72):
gTA TTA CCg Cgg CTg CTg         (SEQ ID NO: 21)
```

Note: The MxF and MxR primers both target the Methanomethylophilales close to M. alvus and those close to M. luminyensis. It is possible to determine which of these lines controls the other (or whether there is codominance), in a qualitative way, by observing dissociation curves: the amplicons of M. alvus dissociate around 84° C. while those of M. luminyensis dissociate around 85.5° C. This dissociation temperature difference has never been clearly defined for Methanobacteriales.

Composition of the Mix:
Use of the Eurogentec MESA GREEN qPCR Master Mix kit

| Mix | Volume (µl) |
| --- | --- |
| Final volume | 18 |
| Master Mix | 9 |
| Primer F | 0.8 |
| Primer R | 0.8 |
| H$_2$O | 5.4 |
| gDNA | 2 |

Condition of the qPCR with the Primers Above:
First segment:
95° C. for 10 min
Second segment:
95° C. for 30 s
59° C. for 20 s
72° C. for 30 s
80° C. for 20 s→readout of fluorescence
Third segment (dissociation curve, defined by the apparatus):
95° C. for 1 min
59° C. for 30 s
95° C. for 30 s Note: the readout is performed at 80° C. so that the aspecific double strand DNA is denatured (around 76° C.) before the readout.

DNA Extraction with Heat and Preparation of the Quantification by qPCR

Transfer a little more than 100 µl of culture (with a 1 ml syringe of the 23G type, crossing the septum of the anaerobic culture tube) into an Eppendorf tube Retransfer 100 µl of this sample (with a P100) into another tube Centrifuge at 16,000 g; 4° C.; 10 min; this allows sedimentation of the cells, and gets rid of inhibitors present in the culture medium.

During centrifugation, put 90 µl of milliQ water in 1.5 ml Eppendorfs

Replace the supernatant with 100 µl of distilled H$_2$O; this gives the possibility of removing the free DNAs from dead cells, PCR inhibitors, and generation of an osmotic shock which facilitates lysis.

Add a spatula touch of glass beads of 0.2 µm, and vortex for 5 s

Place in the Thermomixer; at 99° C. without stirring for 3 min, with stirring at 1,400 rpm for 7 min, without stirring for 10 min; the cells are lyzed by the heat Prepare the PCR mix by mixing the water and the primers.

Centrifuge at 16,000 g; 4° C.; 10 min; the cell debris are sedimented and the dissolved content of the cells, including DNA, remains in the supernatant.

Add the master mix into the PCR mix, and begin to spread it out on the plate.

Pick up again 10 µl of supernatant in a clean tube and add it to the 90 µl of milliQ water;

Place the tubes in ice until quantification.

From the qPCR apparatus, on the computer, start the MxPro software package and select «Sybr assay with dissociation curve» in order to allow preheating of the lamp during the dissolution of the gDNAs on the PCR plate.

Distribute the gDNA samples on the plate.

Check that all the wells are well closed.

Centrifuge the plate at a max of 500 g for 5 s in order to make the mixes fall to the bottom of the wells.

Re-enter the PCR program and the plate plan into the software package.

EXAMPLE 2

Preparation of a Composition

The final culture obtained in Example 1.1, containing the methanogenic microorganism of the invention is used for preparing an administrable composition. However, it is preferably usable as a stock, for carrying out cultivations under anaerobic conditions and in the presence of hydrogen and of a substrate containing methanol, propagating the microorganism and preparing batches for making the composition according to the invention. The medium and the cultivation conditions are then those as described earlier (DSM 141 medium, supplemented with methanol, under an anaerobic atmosphere containing $H_2$). The obtained cultures are optionally concentrated and are freeze-dried, before being incorporated into enteric gelatin capsules.

EXAMPLE 3

Preparation of a Composition

A culture of the DSM No. 25720 strain is produced, and the cultures are used for preparing batches for making the composition according to the invention. The cultures are made under anaerobic conditions and in the presence of hydrogen and of a substrate containing methanol (for example, DSM 141 medium, supplemented with methanol, under an anaerobic atmosphere containing $H_2$). The obtained cultures are optionally concentrated and are freeze-dried, before being incorporated into enteric gelatin capsules.

EXAMPLE 4

Preparation of a Composition

A culture of the DSM No. 25720 strain is produced, and the cultures are used for preparing batches for making the composition according to the invention. The cultures are made under anaerobic conditions and in the presence of hydrogen and of a substrate containing methanol (for example, DSM 141 medium, supplemented with methanol, under an anaerobic atmosphere containing $H_2$). The obtained cultures are optionally concentrated and are freeze-dried, before being incorporated into vaginal suppositories. These vaginal suppositories are administration forms suitable for being placed in the vagina.

EXAMPLE 5

Pure Culture of Methanomassiliicoccus Luminyensis in the Absence or in the Presence of TMA Composition of the Culture Medium Before preparing the composition of the culture medium, three aqueous solutions comprised in the composition of the culture medium are prepared. These three solutions are an aqueous solution of vitamins, an aqueous solution of trace elements and an aqueous solution of fatty acids.

Composition of the Aqueous Solution of Trace Elements:

TABLE 1

| Composition of the aqueous solution of trace elements | |
|---|---|
| Distilled water | 1000 ml |
| Nitriloacetic acid | 1.5 g |
| Magnesium sulfate hydrate ($MnSO_4 \cdot H_2O$) | 0.5 g |
| Iron sulfate heptahydrate ($FeSO_4 \cdot 7H_2O$) | 100 mg |
| Cobalt sulfate heptahydrate ($CoSO_4 \cdot 7H_2O$) | 180 mg |
| Zinc sulfate heptahydrate ($ZnSO_4 \cdot 7H_2O$) | 180 mg |
| Copper sulfate pentahydrate ($CuSO_4 \cdot 5H_2O$) | 10 mg |
| Aluminium and potassium sulfate dodecahydrate ($KAl(SO_4)_2 \cdot 12H_2O$) | 20 mg |
| Boric acid ($H_3BO_3$) | 10 mg |
| Sodium molybdate dihydrate ($Na_2MoO_4 \cdot 2H_2O$) | 10 mg |
| Nickel chloride hexahydrate ($NiCl_2 \cdot 6H_2O$) | 30 mg |
| Sodium selenite ($Na_2SeO_3 \cdot 5H_2O$) | 30 mg |

The aqueous solution of trace elements is prepared by mixing the compounds with the proportions indicated in table 1 in 1,000 ml of distilled water at room temperature and at atmospheric pressure.

Composition of the Aqueous Solution of Vitamins:

TABLE 2

| Composition of the aqueous solution of vitamins | |
|---|---|
| Distilled water | 1000 ml |
| Biotin | 2 mg |
| Folic acid | 2 mg |
| Pyridoxine hydrochloride | 10 mg |
| Thiamine hydrochloride dihydrate | 5 mg |
| Riboflavin | 5 mg |
| Nicotinic acid | 5 mg |
| Pantothenic acid | 5 mg |
| Vitamin B12 | 0.1 mg |
| Aminobenzoic acid (vitamin L) | 5 mg |
| Lipoic acid | 5 mg |

The aqueous solution of vitamins is prepared by mixing the compounds with the proportions indicated in Table 2 in 1,000 ml of distilled water at room temperature and at atmospheric pressure.

Composition of the Aqueous Solution of Fatty Acids:

TABLE 3

| Composition of the aqueous solution of fatty acids | |
|---|---|
| Distilled water | 20 ml |
| Valeric acid | 0.53 ml |
| Isovaleric acid | 0.53 ml |
| 2-methylbutyric acid | 0.53 ml |
| Isobutyric acid | 0.53 ml |

The aqueous solution of fatty acids is prepared by mixing the compounds with the proportions indicated in Table 3 in 1,000 ml of distilled water at room temperature and at atmospheric pressure.

Composition of the Culture Medium:

TABLE 4

| Composition of the culture medium | |
|---|---|
| Distilled water | 1000 ml |
| Magnesium sulfate heptahydrate ($MgSO_4 \cdot 7H_2O$) | 0.4 g |
| Ammonium chloride ($NH_4Cl$) | 0.4 g |
| Calcium chloride dihydrate ($CaCl_2 \cdot 2H_2O$) | 0.05 g |
| Sodium chloride (NaCl) | 0.4 g |
| Potassium dihydrogen phosphate ($KH_2PO_4$) | 0.5 g |
| Aqueous solution of trace elements | 10 ml |
| Aqueous solution of vitamins | 10 ml |
| Aqueous solution of fatty acids | 20 ml |
| Iron sulfate heptahydrate ($FeSO_4 \cdot 7H_2O$) | 2.0 mg |
| Sodium acetate | 1 g |
| Yeast extract | 1 g |
| Sodium formate | 2 g |
| Ruminal liquid | 50 ml |
| Resazurin | 0.7 mg |

Preparation of Tubes Comprising the Composition of the Culture Medium

The composition of the culture medium is brought to the boil for 5 minutes, and is then cooled under a nitrogen-containing atmosphere ($N_2$). When the temperature is below 50° C., 4 g of sodium bicarbonate ($NaHCO_3$) are added per liter of composition of the culture medium. The composition of the thereby obtained culture medium is distributed into anaerobic culture tubes of the "Hungate" or "Balch" type under an $N_2$ atmosphere, and these tubes are then placed in an autoclave for 20 minutes at 120° C.

The composition of the culture medium comprised in the tubes has a pH of 7.4.

Preparation of Pure Cultures of Methanomassiliicoccus Luminyensis (M. Luminyensis)

Three series of tubes having differences in the composition of their gaseous phase, in the presence or in the absence of $H_2$ and in the composition of the culture medium, in the presence or in the absence of trimethylammonium hydrochloride (TMA.HCl), are designated as A, B and C, and are prepared in the following way from tubes comprising the composition of the initial culture medium as described above.

0.1 ml of a sterile solution of sodium sulfide ($Na_2S$) at 15 g/l (0.2 M) is added to the composition of the culture medium comprised in the tubes of the A, B and C series, so that a final concentration of 3.5 mM of $Na_2S$ is obtained in each of the tubes.

An anoxic and sterile aqueous solution of trimethylammonium hydrochloride (TMA-HCl) was also added (0.2 ml at 1 M) in each of the tubes of the A and B series so that a final concentration comprised between 35 and 40 mM of TMA.HCl is obtained in each of the tubes of the A and B series.

The pre-culture of the strain M. luminyensis B10 (DSM25270) is inoculated in an amount of 10% of the volume of the composition of the culture medium comprised in each of the tubes.

The atmosphere of the tubes (initially only containing $N_2$) is modified by adding $CO_2$ in the whole of the tubes of the A, B and C series and by addition of $H_2$ in the whole of the tubes of the A and C series in order to obtain the gas compositions described in Table 5.

TABLE 5

| Compositions of the anaerobic atmosphere | | | |
|---|---|---|---|
| Atmosphere composition (%) | Tube series A | Tube series B | Tube series C |
| $H_2$ | 55 | 0 | 55 |
| $N_2$ | 35 | 85 | 35 |
| $CO_2$ | 10 | 15 | 10 |

The tubes of the A, B and C series are incubated at 37° C., and tracking of the culture of M. luminyensis is performed over time, punctuated by samplings and dosages indicated by a cross according to the program described in Table 6 below.

The conducted measurements for tracking the culture of M. luminyensis in the tubes of the A, B and C series are the measurement of the optical density (O.D.) at a wavelength of 600 nm, the measurement of the remaining trimethylamine concentration in each tube, the measurement of the proportion of dihydrogen ($H_2$) in the gas phase and the measurement of the methane ($CH_4$) proportion in the gas phase.

The measurement of the dihydrogen ($H_2$) proportion is an indicator of $H_2$ consumption during the production of methane ($CH_4$) (from trimethylamine) and the measurement of the methane ($CH_4$) proportion in the gas phase. The measurement of the O.D. gives the possibility of quantifying by turbidimetry the cell growth of M. luminyensis.

The measurement of the amount of trimethylamine by M. luminyensis is conducted according to the method described by Kratzer et al. (2009, Journal of Bacteriology, 191 (16), pp 5108-5115, "Transcriptional Profiling of Methyltransferase Genes during Growth of *Methanosarcina mazei* on Trimethylamine"), with the following modifications:

200 µl of culture are sampled from each tube comprising the culture and placed in a sterile tube, the tube comprising 200 µl of culture is centrifuged at 13,000 g for 10 min, and 50 µl of supernatant are sampled from this tube and again placed in a sterile tube, 783 µl of distilled water and 125 µl of sodium bicarbonate ($NaHCO_3$) at 20% (m/v) are added into the tube comprising 50 µl of supernatant, 42 µl of Fiolin-Ciocalteu reagent are then added, the thereby obtained tube is left for stirring for 60 min, and then the absorbance of the solution comprised in this tube is measured at 745 nm relatively to a calibration range covering a concentration from 0 to 50 mM of TMA made according to the same procedure.

The gas composition of the anaerobic atmosphere in which are placed the tubes of series A, B and C is determined by gas chromatography from a gas volume of 2 mL sampled through the septum.

An average of the values measured for O.D., of the amounts of trimethylamine and of the amounts of $H_2$ in each tube overtime according to the M. luminyensis cultures comprised in each series of tubes is indicated in Table 7 below.

TABLE 6

Program of samplings and dosages over time in order to ensure the tracking of the *M. luminyensis* culture in tubes of the A, B and C series.

| | Time (hours) | | | | | | | | | | |
|---|---|---|---|---|---|---|---|---|---|---|---|
| | 0 | 24 | 48 | 72 | 104 | 149 | 173 | 197 | 247 | 295 | 388 |
| O.D. at 600 nm | X | X | X | X | X | X | X | X | X | X | X |
| TMA dosage | | X | | | | X | | X | | | X |
| Measurement of $CH_4$ | X | | X | | X | | | | | | X |
| Measurement of $H_2$ | X | | X | | X | | | | | | X |

TABLE 7

Averages of the values of O.D., of the amounts of trimethylamine and of the amounts of H$_2$ measured in the tubes of series A, B and C over time for cultures of *M. luminyensis* comprised in each of the series A, B and C of tubes.

| | Sampling time in hours | | | | | | | | | | |
|---|---|---|---|---|---|---|---|---|---|---|---|
| | 0 | 24 | 48 | 72 | 104 | 149 | 173 | 197 | 247 | 295 | 388 |
| Average of the measurements of O.D. for the culture of *M. luminyensis* in tubes of series A | 0 | 0 | 0.01 | 0.03 | 0.05 | 0.08 | 0.10 | 0.12 | 0.14 | 0.16 | 0.19 |
| Average of the measurements of O.D. for the culture of *M. luminyensis* in tubes of series B | 0 | 0 | 0.01 | 0 | 0.01 | 0.01 | 0 | 0 | 0 | 0 | 0 |
| Average of the measurements of O.D. for the culture of *M. luminyensis* in tubes of series C | 0 | 0 | 0 | 0 | 0 | 0 | 0 | 0 | 0 | 0 | 0 |
| Average of the concentration in mM of TMA in the tubes of series A | x | 39.9 | x | x | x | 24.0 | x | 22.6 | x | x | 12.2 |
| Average of the concentration in mM of TMA in the tubes of series B | x | 38.0 | x | x | x | 35.6 | x | 35.7 | x | x | 34.2 |
| Average of the concentration in mM of TMA in the tubes of series C | x | 0 | x | x | x | 0 | x | 0 | x | x | 0 |
| Average of the percentage of CH$_4$ produced by the culture of *M. luminyensis* in tubes of series A | 0.02 | x | x | 2.65 | x | 8.15 | x | x | x | x | 20.49 |
| Average of the percentage of CH$_4$ produced by the culture of *M. luminyensis* in tubes of series B | 0.03 | x | x | 0.04 | x | 0.38 | x | x | x | x | 0.33 |
| Average of the percentage of CH$_4$ produced by the culture of *M. luminyensis* in tubes of series C | 0.03 | x | x | 0.03 | x | 0.04 | x | x | x | x | 0.03 |
| Average of the percentage of H$_2$ in the tubes of series A | 55.42 | x | x | 50.14 | x | 44.02 | x | x | x | x | 30.46 |
| Average of the percentage of H$_2$ in the tubes of series B | 0.10 | x | x | 0.89 | x | 0.71 | x | x | x | x | 0.67 |
| Average of the percentage of H$_2$ in the tubes of series C | 55.10 | x | x | 55.20 | x | 54.20 | x | x | x | x | 55.10 |

A growth of the M. luminyensis culture is observed only in the tubes of series A providing both TMA, which is used by M. luminyensis and decreases over time, and $H_2$. This growth of the M. luminyensis culture requires production of methane ($CH_4$), the content of which increases over time.

SEQUENCE LISTING (21 sequences)

SEQ ID NO: 1 - protein, 504 aa, Methanomethylophilus alvus
  MISC_FEATURE (336)..(336): pyrrolysine
MGVTTPEYPAQNILNGIKFELFSDDEIRRIDMATRDVLETYGVQVSDVEGREIFKAAGCPVDEETQMVKIPGHVLDRALSTVPKKFYLYGRDESRTFTQEWKGKVHYTCFGTGIQVCDYKGHGKYETRDSNEEDLANIARLCDWCDGLSYFSLPVSARNWAGKGAEDVHECLTSMMNTTMHFHHIDPVAGNVEYYRDMVLAYYHGNEAEAKAKPIMSMLVCPTSPLELSYNAAQCIIKGARYGIPVNVLSMAMAGGSSSVFLAGTLVTHNAEVLSGIVLSQLTCPGAKVWYGSSTTTFDLKRGTAPVGSPELGLISASVAKLGQYYKCPVFTAGMXTDAKVPDGQAGHEKTITSLLAALAGVNMIYGSGMLELGMTFSMEQMVIDNDIIRMERKVMEGVPVTDETLAVDAIKEIGVGNDFIAHPSTMENIDLASDPLVFDRLMLGDWRNNGYKDAADVAHEIVVDVLKNHAVKPIDADVLKEMQAIAKKADEAYLARAKAEENE

SEQ ID NO: 2 - protein, 497 aa, Methanomassiliicoccus luminyensis
  MISC_FEATURE (334)..(334): pyrrolysine
MVKHYYPGRQRFEGAGLELFAEEGLRAIDYATMDVLQNPGIQVSDPEALQIFKEAGCEVDEQTSVVKIPEYLVRRALSTAPSKYTMYGREKKNKVEIEHLGKVHWTCFGTGIKMCNYIAPGQYKTVDSTDKDLAATAKLVDWAENIDYYSLAVSARDWAGKGKEDVHEMYTSVMNTSKHFHHIDPVGENVEYYFELAKAIYGGNEQDALKKPLFSMLVCPTSPLELSHNACQVIMKGARFGIPTNVLSMAMSGGSSPIFLAGTLVTHNAEVLAGIVLSQLVTPGAKVMYGSSTTTFDVKRGTAPVGSPELGLISASVAKLGQYYGLPTFVAGIXADAKIPDVQAGHEKTLTTLLPALAGANTIYGAGMLELGMTFSMEQLLIDNDIASMIKKVQQGIEITEETLGVESIQKVGIGNNFLGHKSTMNNVDLPSDPQLFNRDMIGDWVKEGSRDLVTVAHEKVLQIMKTHEVTPIDADIVKAMKAVVDKGDRAFKGIKE

SEQ ID NO: 3 - DNA, 1503 bp, Methanomethylophilus alvus
atgggagtaactacacccgagtatcccgctcagaacattctgaacggaatcaaattcgaactgttcagcgacgatgagatccgcaggatcgacatggctaccagggatgtcctcgagacatacggtgtccaggtttcggacgttgagggaagggagatcttcaaggcagcgggatgccccgttgacgaggagacccagatggtcaagatccccggacacgtcctcgacagggcactttccaccgtcccgaagaaattctacctgtacggacgcgacgagagcaggaccttcacccaggagtggaaaggcaaggtgcactacacctgcttcggaaccggtatccaggtctgcgactacaagggccacggcaaatacgagaccagggactccaacgaggaggacctcgccaacatcgcaaggctctgcgactggtgcgacggactgtcctacttctccctgcctgtttccgcaaggaactgggctggaaagggagccgaggatgtccacgagtgcctgacgtccatgatgaacaccaccatgcacttccaccacatcgaccccgtcgctggaaacgtcgagtactaccgcgacatggtcctcgcatactaccacggcaacgaggccgaggcaaaagcgaagcccatcatgtccatgctggtctgccccacctcccctctcgagctgtcctacaacgcagctcagtgcatcatcaagggagcaaggtacggaatccccgtgaacgttctgtccatggccatggccggcggatcctcttccgtcttcctggcaggaaccctcgtcacccacaacgccgaggtcctttccggaatcgttctgtcccagctgacctgccccggcgcaaaggtatggtacggatcttccaccaccaccttcgacctgaagaggggaaccgcacctgtaggatcccccgagctcggactgatctccgcatccgtcgcaaagctcggacagtactacaagtgccccgtcttcaccgccggtatgtaggtgcccgatggacaggctggtcacgagaagaccatcacctccctcctcgcagcactcgctggcgtcaacatgatctacggatccggaatgctcgagctcggaatgaccttctccatggagcagatggttatcgacaacgatatcatcaggatggagaggaaggtcatggagggtgtccccgtaaccgacgagaccctcgccgtcgacgcaatcaaggagatcggagtcggaaacgacttcatcgcccacccctccaccatggagaacatcgaccttgcgtccgaccccctggtattcgacaggcttatgctcggagactggaggaacaacggctacaaggatgcagccgacgttgcccacgagatcgtcgtcgacgtcctgaagaaccacgctgtcaagcccattgacgccgacgttctgaaggagatgcaggccatcgcaaagaaggccgatgaggcgtacctcgcccgcgcaaaggctgaggagaacgagtaa

SEQ ID NO: 4 - DNA, 1494 bp, Methanomassiliicoccus luminyensis
atggttaaacactactatccagggaggcaacgctttgaaggtgccggtctggaactcttcgccgaagagggtttaagggccattgactacgctaccatggatgttttgcagaaccccggtatccaggtatcggatcccgaggccctgcagatattcaaggaagcaggctgcgaagtcgatgagcagacctctgtggtcaagatcccggaatacctggtaagacgcgctttgagcactgcgccctctaagtacaccatgtacggtagggaaaagaagaataaagtggagatagagcaccttggcaaggtccattggacctgcttcggtaccggcatcaagatgtgcaactacatcgcccccggccagtacaagaccgtggactccaccgacaaggacctggccgcgaccgccaagctggtggactgggctgagaacatcgattactactcacttgctgtatcggcgagggactgggccggaaagggcaaggaagacgttcacgagatgtacacctcggtcatgaacacctccaagcacttccaccacatcgaccccgtcggcgagaacgttgagtactacttcgagctcgccaaggccatctacggtggcaatgagcaggacgctctcaagaagcccctgttctctatgctggtgtgccccacgagccccctggagctgagccacaacgcttgccaggtcatcatgaagggcgctcgctttgggatacccacgaacgttctcagcatggccatgtccggcggctcgtccccgatattcctcgccggaacgctggtgacgcacaacgctgaggtcctggcaggcatcgtcctgtctcagctggtcacccccggcgcgaaggtcatgtacggcagctccaccacgacattcgatgtcaagaggggtaccgctcctgtcggatcccccgaactcggactgatcagcgcatcagtcgcaaagttgggccagtactatggtctgccaactttcgtggcgggcatataggctgatgccaagattccagatgtgcaggcgggccacgagaagaccctcactactcttctccccgctctggccggtgcgaacaccatctatggcgccggtatgctggaacttggcatgacattctcgatggaacagctgctgatcgacaacgatatcgcttctatgatcaagaaggtccagcagggcatcgagatcaccgaagagacgcttggcgtggaatcgatccagaaagtaggcatcggcaacaacttcctcggccacaagtccacgatgaataacgtcgatctgccttctgatcctcagttgttcaacagggacatgatcggcgactgggtgaaggaaggttctagggatctggtcaccgtcgctcacgagaaggtccttcagatcatgaagacccacgaggtcaccccgatcgatgctgacatcgtcaaggcaatgaaggccgtcgtcgacaagggcgacagggctttcaagggcatcaaggagtga

SEQ ID NO: 5 - protein, 216 aa, Methanomethylophilus alvus
MTQEELNERAKKAVLTYNINESKKVAQDALDQNADIVDLIQNGFTVGINQVGDLYEQKKLFLPHIMAAANAMNAGVDILTPHLGAQAKTADNLGKFVICTIEGDIHSIGKDIAAIMLKVAGFDVINLGRDIPLKDIAKAVADNNAIAVGTSALMTSTMVNQKAFEEIMKKQGLKGKCLTNVGGAPVTQQWADEIGADVYSENAQDCAAKMVKAVKG

SEQ ID NO: 6 - protein, 216 aa, Methanomassiliicoccus luminyensis
MANKDQILEDARNAVLEYDADAAVEAAQASIKAGISPVDMIQDGFSKAMNEVGAKFGEKKLFLPHVIAAAEAMTKGIEVLTPELEKQGTKEGPGLGTVVIGTIEGDIHSIGKDIVAIMLKIAGFNVMNLGRDIPVSQFIDVAKKNDARVIGTSALMTSTMVNQIRVEELLKEEGLKSKIKTMVGGAPVTQQWADQIGADLYAENATDSVNRLKAAL

SEQ ID NO: 7 - DNA, 651 bp, Methanomethylophilus alvus
atgacccaggaagagcttaacgagagagcaaagaaagcagttctgacctacaacatcaacgagtccaagaaagtagcgcaggatgcacttgaccagaatgcagacatcgtcgacctgatccagaacggattcaccgttggaatcaaccaggtcggagacctctacgagcagaagaaactgttcctgccccacatcatggcggcagccaacgcaatgaacgcaggagtcgacatcctgaccccccacctcggtgcacaggccaagaccgccgacaacctcggaaagttcgtcatctgcaccatcgagggagatatccactccattggaaaggatatcgcagccatcatgctgaaggtcgccggattcgatgtcatcaacctcggccgtgacattccgctcaaggacatcgccaaggcggtcgccgacaacaacgccatcgcagtcggaacctccgccctcatgacctccaccatggtcaaccagaaggccttcgaggagatcatgaagaagcagggactgaagggcaagtgcctcaccaacgtcggtggagcacccgtcacccagcagtgggccgatgagatcggagcagacgtctactccgagaacgctcaggactgcgcagccaagatggtcaaggctgtcaagggctga

SEQ ID NO: 8 - DNA, 651 bp, Methanomassiliicoccus luminyensis
atggcaaataaagaccagatactagaagacgcaaggaacgcagtgctggagtacgacgctgacgccgcggtcgaagcggcccaggcatccataaaggcgggcataagcccggtcgatatgatccaggacggcttctccaaggcaatgaacgaggtaggcgccaaattcggcgagaagaagctgttcctgccccacgtgatcgcggccgccgaggccatgaccaaggggatcgaggtcctcactcccgagctcgagaagcagggaacgaaagagggtcccggcctcgggaccgtggtgatcggaacgatcgagggcgacatccacagcatcggcaaggacatcgttgccatcatgctgaagatcgcgggcttcaacgtgatgaacctggggagggacatccctgtctcccagttcatcgacgttgccaagaagaacgacgctcgcgtgatcggcacttccgcgctgatgaccagcacaatggtcaaccagatcagggtagaggagctcctcaaggaagagggcctgaagtccaagatcaagaccatggtgggcggggccccggtgacccagcaatgggcggaccagatcggtgccgacctgtacgctgagaacgccaccgattccgtcaacaggctgaaggcggccttataa

SEQ ID NO: 9 - protein, 300 aa, Methanomethylophilus alvus
MCMAATYKDKDHYFGRNLDLEISYGQKVVVTPRNKEFAYRHENAEKTHLALIGMAAVVDGCPLYFDATNENGLSMAGLNFPGNAYYGEMKEGSHNIAPFEFIPWVLCKCSTVEEARALISGTNLIDEDFSDALPASPLHWIVSDRESSIVVEYMESGLSIYDDPAGILTNNPPFPFHMHNLANYMNLSAGVPENRFSKDIDLRPYSRGMGAMGLPGDLSSASRFVKAAFTKLNSLSDGTEEGGMTQFFHIMDSVQQQMGCCYLGDEKYEYTIYTSCCDTDKGIYYYRTYGNSQITGVDMH

SEQ ID NO: 10 - DNA, 975 bp, Methanomethylophilus alvus
atgtgcatggcagccacctataaggacaaggaccactacttcggacgcaacctcgacctggagatatcctacggccagaaggtcgtcgtgactccccggaacaaggagttcgcataccgtcacgagaatgcggagaagacacatctggcacttatcgggatggccgccgtggtcgatggatgtcctctctacttcgatgccaccaacgagaacggcctgagcatggccggcctcaatttcccaggcaacgcatactatggggagatgaaggaaggatcccacaacatagcccccttcgagttcataccgtgggtactctgcaagtgctccacggtagaggaggcgagggccctgatatccgggacgaatctcatcgatgaggatttcagcgatgctctgccggcctccccccttcattggatcgtctccgacagggagtcgtccatcgtcgtggaatatatggaatcgggcctgtcgatctacgacgacccggccgggatacttaccaacaacccgccgttcccgttccacatgcacaatctggccaactacatgaacctgtcagcaggtgtcccggagaacagattctccaaggacatcgacctcaggccttacagcagggggatgggtgccatgggactcccgggagacctgtcctccgcatccagattcgtcaaggcggcgttcaccaagctgaactccctgtccgacgggacggaggaagggggaatgacccagttcttccacataatggactccgtacagcaacagatggggtgttgctatctcggtgacgagaagtacgaatacacgatatacacgtcatgttgcgacaccgacaaggggatctactactacaggacctatggaaacagccagataacgggggtggatatgcaccgcaccgatctggactccgatgtcctggccgaattccccctggtggaaggacagcacgtcctgatgcagaactaa

SEQ ID NO: 11 - DNA, 1461 bp, Methanomethylophilus alvus
ggttgatcctgccggcggccaccgctataggaattcgattaagacatgcgagtcgagagcgcaagctcggcggactgctcagtaacacgtggacaacgtgccctaaagtgggggataatcaggggaaactctggataataccccatagatcatgagatctggaatgacttatggttcaaagttccggcgctttaggatcggtctgcggcctatcaggtagtagtgggtgtaatgtaccccctagcctattacgggtatgggccttgagagagggagcccagagttggattctgagacacgaatccaggccctacggggcgcagcagtcgcgaaaacttcacaatgggcgaaagcccgatgagggaattcctagtgctagcacttttgtgttagcttttctttagcgtagataactagaggaataagggctgggtaagacgggtgccagccgccgcggtaatacccgcagcccgagtggtggtcgattttattgagtctaaaacgttcgtagccggtctgatagatccttgggtaaatcggggggcttaaccttccgaattccgaggagaccgtcaggcttgggatcgggagaggtaagaggtacttcaggggtaggggtaaaatcctgtaatccttggaggaccaccggtggcgaaggcgtcttactagaacgaatccgacggtgagggacgaagccctaggtcgcaaacgggattagataccccggtagtctagggtgtaaacgctgcagacttggtgttggaggcccttcgggggcattcagtgccggagagaagttgttaagtctgctacttggggagtacgtccgcaaggatgaaacttaaaggaattggcgggggagcaccgcaacgggaggagcgtgcggtttaattggattcaacaccggaaaactcaccaagggagaccatcacatgaaagccaggctaatgactttgcttgattcttggagaagtggtgcatggccatcgtcagttcgtactgtaaagcgttctcttaagtgagataacgaacaagaccctcacttataattgctaactagatctccggatctggtgcacattatcgggaccgctggcgctaagtcagaggaaggagaggtcaacggtaggtcagtatgccctgaatctcttgggctacacgcgcgctacaaagggcgggacaatgagttccgacaccgaaaggtgaaggtaatctccaaacccgtccgtagttcggactgagggttgtaactcaccctcacgaagctggattccgtagtaatcgcgaatcaaaaactcgcggtgaatatgcccctgctccttgcacacaccgcccgtcaaaccacccgagtcgggtttcagtgaggctgccttttattggggtattcgagctgagattcagcaagggaggttaagtcgtaacaaggtatctgtaggggaacctgcagatggatcacctcct

SEQ ID NO: 12 - DNA, 1463 bp, Methanomassiliicoccus luminyensis
ggttgatcctgccggcggccaccgctattggaatacgattaagacatgcgagtcgagagacgtaaggtctcggcagaccgctcagtaacacgtggataacatgccctaaggtgggggataatctcgggaaactgaggataataccccataggtctagcatgctggaatgctactaggccgaaaactccggtgccttaggattggtctgcggtctatcaggcagtagtgggtgtaatggacccactagcccgtgacggatatgggccttgagagagggagcccagagatggactctgagacatgagtccaggccctacggggcgcagcagtcgcgaaaacttcgcaatgggggaaaccccgacgagggaattccaagtgccagcactttgtgttggctgttcttctgtctaaaaaacaggagaagtaaggggcgggtaagacgggtgccagccgccgcggtaatacccgcgccccaagtggtggtcgatattattgagcctaaaacgtccgtagccggtcttctaaatccttgggtaaatcgggcagctcaactgtccgaattccggggagactgggagacttgggaccgggagaggtcagaggtacttctggggtaggggtaaaatcctgtaatcctggaaggaccaccggtggcgaaggcgtctgactagaacggatccgacggtgagggacgaagccctggggcgcaaacgggattagataccccggtagtccagggtgtaaacgctgcgggcttggtgttgggggtccttagtgggcgcccagtgccggagagaagttgttaagcctgctgcttggggagtatgtccgcaaggatgaaacttaaaggaattggcgggggagcaccgcaacgggaggagcgtgcggttcaattggattcaacgccgaaaaactcaccaggagcgacggatatatgaaggtcaagccgatgactttacctgattttccgagaggtggtgcatggccgtcgtcagttcgtaccgtaaggcgttctcttaagtgagataacgaacgagaccctcaccattaattgctagtcccttctccggagggggcgcacattaatgggaccgctggcgctaagtcagaggaaggagaggtcaacggtaggtccgtatgccccgaatcccctgggcaacacgcgcgctacaaaggacgggacaatgggcttcgacaccgaaaggtggagacaatcctgaaacccgtccatagttcggattgggggctgtaacccgcccccatgaagctggattccgtagtaatcgcttgtcaacatcaagcggtgaatatgcccctgctccttgcacacaccgcccgtcaaaccacccgagttgggtttcagtgaggatgtttcttattggggctttcgaactgagattcagcaaggagggttaagtcgtaacaaggtatctgtaggggaacctgcagatggatcacctcct

SEQ ID NO: 13 - DNA, 1666795 bp, Methanomethylophilus alvus
ctcattcagaatttctactagtgtagatatagcgcccactgcgtgttcaccgcccgtctaaaactcattcagaatttctactagtgtagatatagcgcccactgcgtgttcaccgcccgtctaaaactcattcagaatttctactagtgtagatggtgccgtccgcttccctgccatttcgtctaaaactcattcagaatttctactagtgtagattgattgatggatgccgatgcggacgatgtctaaaactcattcagaatttctactagtgtagattatgacatccgccattgattatatgtgtctaaaactcattcagaatttctactagtgtagatggttggaccgtgttggaccgtgtccagtctaaaacccaaattctgcgcgtgctaagtaatcgcaatcctgttttctgatcaatttttcatatgctggctagggtacggtaagaggtgttatataccattacttacatacagtttatgttaggtaataacatggtcagaccgagggatggagacggaatcaaacgcacgatcgtcaaaagaggggacagattctatgcttatgaggtaacctctactatggaaaacggtaagaaaaagaccgtttccacctacttgggcagggtggatcccgacaccaaggagctgcttcccaagattcccgaaaaatctgcagagaaccgcagaaaaatcgcgaaagagaaggagatcgcgattctcaaaggtgtgtcgtcaaaggagtacggggcgacatacctgctgcacgaagtgcagctgaggatgtccctcggcgaggacctcatgagggcattcggcaattcggggaagaccattctcgcggctgcgatggcctatcttatggaaccgggcgcattcaggaacatagattccactttggagaggacgtacatccgcgaattctatgatctcagagcatcgatggattcgggaacgctttcggacttcaccaggaatctcggggagaaggcgatgaacatcgaccgtttcttcgaactcagggttaagggatccaatgggctggtggcctgggatacgaccaccaacggcacttattcggaactggaccagatggccgaatatgtggtgaacaacaaggacggagaggatatcaagcagacgaagaccggtttcgccacagacatgagaggcatccccctcatgttccgccattatcccggtacgatctccgatatagctaccgtggacaggatggtgtccgacatagaaagatacgggaagaaggatgctttgttcgtattcgacaggggattcgtttcgggtgccaatgtgaaacacctcctggacaaggggataagattcaccgcccctgcgaacacatcctccaaagcgatcaaaacgctgatgtccaggttcgtgaagaccaacgaatctctggatatgattcacgacggacatgcatataaggtgtggaagacgcagatcggtctgacggaagccgacaggctatccgcggacggatcgcaggcatactcctttcacggtgtccggcgatgccggacacggggatgatggtatgatcaacgcatacgtatgtttcgattccaagaagtactccgacgaggtccagaaccacaagatgatgctcaacgatctgaagaggaaggccgcagagatagaatgcaaggatcctgtggccaggttcaagaagatcgctgggaaggcgatcaaacacttcgatgtacaggccgacgggaagaaggtgatcgtcaaggagaagcagaattccgtaagcttcgctgagaaccgcgcgggagtgttcgtcatgttatcctcatcggatctggactggtcgacggttatgacggcatatgacgcaaggagacttaccgaacaggcgttcgatttcagcaaatcggacgacaggaggcaccgtactcccgacaaatacacgatgatcggacgttcgctgataaagttcgtttcactgatcctcaaatgcgaactgtgcgctgagataagggaatccggcaaacgggagatgtccgtcggtcagactctggggtacctgaacacgatcaactgtctgagttacggttcttcgtccgctctttcggagatatccaagaactgcaggaacatcttcggaatgttcggagtggaagtacccaatgaacccgtcttgggcatcgaggtatgcgatctgagatgtctcgcaactcccaagggttgagttacttacacgcgcagaatttcggtctaaaactcattcagaatttctactagtgtagattcggtcaggaagctgcgggccgcgccgtctaaaactcattcagaatttctactagtgtagatcagacgattaagtctaatactgctccgtctaaaactcattcagaatttctactagtgtagatttccaggttatgaactggtcgaactcccgtctaaaactcatctaaaactcattcagaatttctactagtgtagattcggtcaggaagctgcgggccgcgccgtctaaaactcattcagaatttctactagtgtagatcagacgattaagtctaatactgctccgtctaaaactcattcagaatttctactagtgtagatttccaggttatgaactggtcgaactcccgtctaaaactcattcagaatttctactagtgtagataagtggctcactactccaagaccggagtctaaaactcattcagaatttctactagtgtagataacgatattccccacggtgccgtgaacgtctaaaactcattcagaatttctactagtgtagatgtagaattcctgggcttcttcgggcggtctaaaactcattcagaatttctactagtgtagatttaaaattgggaacagtgcgctgcaggtctaaaactcattcagaatttctactagtgtagataagtcttccgttctcaagttcgacctggtctaaaactcattcagaatttctactagtgtagatagcaaccgccagagattcaacgtctgtctaaaactcattcagaatttctactagtgtagatctgatgagggtcgcccacgtggtgcgtctaaaactcattcagaatttctactagtgtagatagtggcggtgaccaccacggccttcttgtctaaaactcattcagaatttctactagtgtagatagagcttcgccaaggacgcagaccgggtctaaaactcattcagaatttctactagtgtagataagaataccacacgtgaacagacactgtttaaaactcattcagaatttctactagtgtagatatgaatctacctcgtctgcgatgatcggtctaaaactcattcagaatttctactagtgtagatgatataaacgtgttacttacggaaggttagtctaaaactcattcagaatttctactagtgtagataaagctcacgtcgtctatcttcagcgtgtctaaaactcattcagaatttctactagtgtagatgctatcgcgctttccatgtccgcctggtctaaaactcattcagaatttctactagtgtagattcgatggagttgatcgcggagcgcatgtctaaaactcattcagaatttctactagtgtagattcaaagcggagcgtaaggctttcgtgggtctaaaactcattcagaatttctactagtgtagatgtctcttcctgatgaagtcggctgtggtctaaaactcattcagaatttctactagtgtagataaagactacgtacggaggaaggggtagtctaaaactcattcagaatttctactagtgtagattaccacggggaaagcgacgagccgcacagtctaaaactcattcagaatttctactagtgtagatcttgcggccttcgacctccgggcgttcgtctaaaactcattcagaatttctactagtgtagataacggacaggccagatgaaggagagagtctaaaactcattcagaatttctactagtgtagattcgcgttcggcggtcagctgcgtcaccgtctaaaactcattcagaatttctactagtgtagatttgaggatgatcctgaagatctgaaggtctaaaactcattcagaatttctactagtgtagatacaaggaccgcctcgagacaaggcgagtctaaaactcattcagaatttctactagtgtagatttgatgaaccgagagagggcgaaacgtctaaaactcattcagaatttctactagtgtagataggaaccatcccgccacgcctccggcgtctaaaactcattcagaatttctactagtgtagataggtgcaaagatattcaggcggcaggggtctaaaactcattcagaatttctactagtgtagatgtatgccctaaaaatgtcgtcataagtgtctaaaactcattcagaatttctactagtgtagatgcaaacaacaacgggccatatttggttggtctaaaactcattcagaatttctactagtgtagatgcaaacaacaacgggccatatttggttggtctaaaactcattcagaatctctactagtgtagataaagatacgcttttggctgtgaagtgggtctaaaactcattcagaatttctactagtgtagattcggttcggcactgccccttttaatgtctaaaactcattcagaatttctactagtgtagatggacggatgactggaggggcttgatgtgtctaaaactcattcagaatttctactagtgtagatttctgtctccacatctgccgccgagggtctaaaactcattcagaatttctactagtgtagatatcgggtggatttcctgtcatgttagtctaaaactcattcagaatttctactagtgtagattcggttcactttttgcggtcaaggtacgtctaaaactcattcagaatttctactagtgtagatgagcaggcacacattgcggatgcatcgtctaaaactcattcagaatttctactagtgtagatgaggtgcggttaccctatcacttccgtcgtctaaaactcattcagaatttctactagtgtagattggccagccttcctgggctaccgtttgtctaaaactcattcagaatttctactagtgtagattcaataacaaaggcaacggactccgcagtctaaaactcattcagaatttctaccagtgtagatcgataggcagagccttcctaacgtgggtctaaaactcattcagaatttctactagtgtagattgattaagacccgagtgtgacagttatcaagtgaatttttgatatggtgcaggggctgacgccctgcacgatacggtctgctggcgatagaataaaagcggcctttcgattcgtttaagtcgccaaacacaaacaggccgaaaggctgtcttccacatcggaatcattcggattaaagttacggtccgggacctgggatgtttggcgggacaagtgatggattgtcgcgcaggatgagcaggatacatgccaggatgccgaagccgaacaacaacctcaccatgaccgtcggcaacaaggtcctggtggaatccgtgttctcggacacgggattggacggattcctggacgatctgaagaggagacagggcaactcggtggcgtccgaaacgatcgcattggtcgcgaactcggtggagatgaccggtctttccgtgaggagactcgatcgccttctggaggatgagagggtccgtgaagagtacggactcggggcgaatgccccgagatccgtctaacgcacggtcgagagattgggtgagaacagcgacgacatcgtatgtttcctgggagagatgatgaggagaaggtacggtgtcggaatggacactgtgttcatggattggacatccatgtacttcgaggcaccccagaacgatttcgtcagagtcggttattcaagggaccatcgtcccgacaggccgcaggtcaccgtcggattgagcatggacagggattccaagatgcacggtcgtaaattcaggctctctccatcgccgagtccaacgccatctccgctatatccgcgcagtactccgccagtctccttgagctccccgccatcacgtccacgggcaggctctcgtccgtcatctccatcctgccgaaggcggacactatcgccttggtctgcgcctccgccatgcggatgcactcctccgacccgtcgcggtcggtgttcatccacgcctgcacgcaggagtccatcagcttcacgatgccgtcccccatggatccgatggccgcacagaggtccttccctccggcctttatcaggtccttggtgtggattgccatgaggacggcgtggtccccgatcctctccaaggtcttgctcacggacacacatccggtgacggtgcggaggtccacccccatgcctgcgctgagaccgatgtccttcaggagtatgcgggactgcctctggaccatccagtggatgcggtccacctccgtgtctctgtcggccatcccctccagcctctcggtgtccatgtcggaggccgcctggaagacgtccgaaaccatgcgcttgaccaacaggtgctcccggcgtatgttcttctgcgggaccacctcggtgatgtccatcaggtcctttatgacgatgcggttctcgtcctcctccactatctccatgccgatggaggtctgggtgaagcgggagacggattccagcatggatcccctcagggggaaggccgaatgcaccgttatggtgcggaatccggctatgtacgctccgatcagctgtctgtagagggccacggagtccggcaccctgtccgcgtcgatctccgtgtcgtcgccctcggagggggcctgtacaccgcccaccgagaggaggaggccccctcccggctgcggcaccaccatgaccgggtcgttcttcttcagaccgaccgattccgcccactccttgggcagggtgatcatgaaagacgaccctccggtgacctgtacccttctgacatccatactggggttatcagaatatatatttatcatattttccccagttctctatatatcatccgaatatcccttggatgtatttcgaggtggtttcgttgtgcgggtcctcgaagatctgcttcgtctccccgaactccatcatctcccccagctgcatgaagccggtatggtcgctgatcctcttggcctgctgcatgttgtgggtcacgatgacgacggtgtagtccttcttcagatcccttaccaggtcctctatctttgccgtggcgatggggtcgagggcggaggtgggctcgtccatgaggatgacgtcggggttgacggccagggccctggcgatgcagagcctctgctgctgtcctccggagagtccgagggcggacctcttgagcctgtccttgacctcgtcccacagggcggcctgcctcagggtcctctcgacgatctcgtcgagctcggacgccttggtgatgccgtggatcctcgggccgtaggtgatgttgtccctgatgctcatggggtaggggttggggcgctggaagatcatcccgatcctcgtcctcacctcgttgacgtcggtcccctcggcgtagatgtcgtttccgcggaaggttatgctgccctccaccctgcacccgtcgatgaggtcgttcatcctgttcatgctgcggaggagggtggacttcccgcatccggaggccccgatgagggccgtcaccccgtgttcttccacgggcatgttgacgcccagcacggcatgcttgtcgccgtaccagacgtccacgttctctatgtccattaccgtgtctctcattgtctcatcctcttctctccgcgggccctcacgtacgacgcgaggaggaacatcgccagcactatgaccaggaggaccagtgcggtggcgtacatcatcgaggggtccgcgcgcccctcggtggccaggtagtaaaggtggtaagggagggccatgaccggttcggtcagggcgtagtccgctaccttcgcctggacgaccacggcggtgaacatgatgggggccgtctcccccgccgcacgggcgaggctgaggatggcaccggtcacgatcccgttgaccgcggtcggaaggactaccctgaaggtggtctgcatcttggtggcgccgatggcgcgggaggcctccctcaggtcgtcagggacggccctgacggcctcctgggtggtccttatgatcaccggcatggtcatgagcgccagggtgacgcatccggctatgaggctgtaccccatcccgaggtagaccacgatgaccaccatgccgaacagtccgaagatgacggagggggtcccgttgaggacgtcgacggcggcggtcacgaccctcgtgaccctgccgttccctccgtactcggtcaggtagacccctgtgagcactccgagggggacggccatcagcgcagtcccggctatgagctcgagggtacccacgatggcggggaagatccctcccgaccttccggccctggaggggtcgtccaggaggaagtcgaggctgagtgcgggcacggccttgaccgcgatgtacacggtcaccagtatcaggatggccacgatggcgaaggtgaccagggagagggacccgcaggccagcttctgcctctggttcctgtcgaccttcctccttccggcggtggcgaggaccttccacacgacgacggtcccgacggccgcggccatggactgcagcgtaccggtgaacagggatgccccgcagaacaccgcggcggcgacggccgcggtcaggaggaggtccttgaacatgcggatcttggtctggtccatgttctcgatggccagggtcaggcgtccgaccttctcgtccccggagaacttcctggcggacctgttcatcacggccctgacggagaggttgatcgcaagtatcattatcatcagtatgagtgcgaggaggaacagcgccgagtaggacgtgctccccacgacgacctcgggcatctccaatgccagggtcgcggtgatggtcctgagcgtcgagaagacgttccatatcggatccgggaagatggcggtgttcccggtgaccatcatgacggccatcgtctctccgatggcccttcctatccccaggatgacggcggcggacataccggaggccgccgcagggactatgaccttcattatggtctcccatttggtggcgccgatggcgagcgaggcctccctgtaggaggacggcaccgtctgcagggcgtcgtcggagacggatatgaccgtgggcagggccatgatccccagcaggacggatcccgtgagccacgagagtccggatacggtctggtcggggaagagaccgtgcatcatcggcacgagtatcatgattccgaggagaccgtataccacggacggtatgccggccatgacctcgatgatgggttttaccttctttctggtcttgggtgaggcgatctccgagaggtagatcgcggcaccgatgccgatggggcaggcgaccatcatggcgcccgccgtcaccatcagggtgccggcgatcagggaggccgcaccgtacgagccgatgtagggcctccacacgctccccgtgaggaattcccagatgcccacttcgctgagggcatcgaatccctgcccggcgatgaagatgatcatcgccacgaccgtgacggccgccaatgaggcgacggcggccaggacggtcctgcagactctgtcggagtccacgggccgggtcttcttcagtacgttcacgcagtcggacatccgggcgcacctcactttcagagggcctcgagggcgataccgagactgacgtatccgatggagtagtcggtggtctcgatgtgcgtcagaagggcgttgttgctggcgaactcgaccatcttgtcggtcacgctgctgctggagaagcctgcgacctttccggagaggagctcctcgaaagcaccgcgggttccggaggaggactcccttccgcatacgtcgatggcgtggtcgactccgccgagctggttccagttggtgtaggtcccgtcgtagatcttggcgatctggtcgagggtcaggttgtcgataccggtcacggacttgttgacgatgatggcgataccgtccttaccgatgacggtggggacgaggcctgcgtcggtctcggaggtcttcaggtcgcgggagagcattccgatgtcggcggtcccgtcgatggccgcggcggctccggtaccggatccgttcgcggtgatgctgatcctgacgttggggtggatcttctcgtattcctcctcgacggccatcatgatggggttgacggtggtcgatccctggatggtgatgctgtaggaggtcttgtcgtcgatggtcgacttgtaggcgggggcggaactgtcgacggcgatgtagtcgttgtcttccacgatcgcctgtccctctgcgctgagcacgtaggagataaggtcggcgaccgctccggaagcggttcctttggtggcgaggataagtcctctctggagggtgtacgaaccgttgaccacgttgtcaacggtggcgtctacgccttcgacattcattatttcaaacttcgcatcgtctttaccgtcgtcgctgttcatcatgaacacggcgacgccggcgatggcgatgattgcaatggccgcaactgctgcgatcttcattgttttatcgtccaagattttcacctcggacagaagtcagaggcgttatggatatatattctgtcgaaatattatatattgaaatatatagtaaatatagatttatttttaaatgtctaaatgcccgcatccagaccggaggagccttcctttccagcgttttccatacgttttccgcgggatcccgcccatttcccttagatttataatctaaaatccccatgatgtccatgggataggatgcattcggaacagctacgcgtagcgatatataccagggtctccaccgaggaccaggcgcgggacggtttctccctcgatgcgcaggaaaagcgtctgaaggcgtacagtgcggtccgcggttgggaggtcgtcgacatctaccgcgacgagggttactccggccgtacggtggcccgtcccgaataccagcgcatgttctccgagatggacaggtgggatgtggtcctcgtcctcaagatggacaggatccacaggaacagcgtcaatttcacccatatgatggaggtcctgaaggacaacgggaaggatttcaactccatgatggagaaattcgactccaccaccgccatggggaggttcgtcatggacatagtggagcgcatggcgcagctggagagcgagcagatcggcgagagggtcaagatcggcatgacccgcaaggccgagacgtccagcggacccatggggtcccccgacccgtacggatacacctacgccggcgggaagctcgtggtcgtggaggacgaggcccgcatcgtacgcaggatattcgacatgtacatggacggcaggaccatggagaacatcgccgccgccctcaccaacgccaacataccctccaagaagggaggggcctggagcagacaggccgtttgcaacatactccacaacccgatatacgcaggatacatgcgctgggacgggatcgtccgtccgggtacgcagaccgccataatccccgtggagaccttcgagtcggtcaacgggcccatatcgtgataccatggtcctggcagccctctacgcacgcgtatccaccgaggagcaggccatagagggttattccatagacgcccagaaggacctcctgtccaactactgcgtggcccaggactacggcatcttcaagatctacgtggacgacggtttctccgggcgcaacgacaaacgtcccgcctaccgcgagatgatggccgagatggacgaatgggatgtgatggtggtcctcaagatggacaggatccacaggaactcccgcaacttcatgaacatgatggacgagctcgggagacatgggaagcagttcatatccgccaccgagaacctggacaccaccaacgccatggggaagttcgtcatgtccatgatacagagcatcgcccagctggagagcgagcagatcggcgaaaggacctatgtggggatgcgcgagaaggcggagacgatgaggaacaccccgcaggggagcaggacgctcggattcaaccccccgtacggctatctcctggacggcggcctcatgacggccgtcccggaggagctgagggtggtccgggaggtcttcgacgaatatctcgccgggaattccctggcgaagatagccgaatccctcaaccgcagcggcctccgtaccaggcgcggcaacaggtggacggtttacaacctgagtaccatactgcataaccccgtgtacgcgggatatctgaggtgggaggacctgaccttccgccattatgcggagacgcccttggaccccgttacgttcaaccgcgtgcagaccatggccatggcgaaggaacggaacccctccaaacgctccccgaggctcctgcccgaagaggacttcgaactgtgagggccaaaatccaattatacttattttccaatcgaaccctctatgaaagcagccactaggaagaagttctatgcatggttcatggtgggcatcatggtcatggtcgtcttcgtcgtcgcagcgagtttcatcgccgggctctgaccccggtaccgtcggaggccgtccacgtccatcgatctcctgtcggcatctgcggtgttcgtcctcacgtattcgctgatagccgtgcgtaaggtgaacggccgcaggataaggacatggacggccgccgtactcggcggagtcctcatgctcctgctcggagtcgtgacaccgtcggaggcgtgggattacatcaatttcgaggtgatcctgcagttggcgggtatgatgatgctcacagcctctctccagtactgcggattcttcgagatcgtcgtggacttcctgatgaggcgcttcgacggcaggaggaggttcctaagcggggtcatggccatcaccgcatgcctgtccgccgtcatgctcaacgatgccgtcgtcctcatattcacccccatagtcctccgctgctgtcagaggatgcgggcggaccccgtgccgtacatggtcggggtgttcgtctccgccaacatagggagcgccgccaccgtcgtgggcaacccgcagaacgccttggtggcgtccatggccgggatcggtttcttggactactccatacgcgtaatccccctgacggtcatatgcatggccgtcgcgatgctgatgatgcgccgcatgtacggcggccgtctggataccgacgacgcatcgctctccggagagacgttccataccagggaggtcgacaagtatcgtctctgcgccgtcctagccgtcaccgtcaccgccctcgtccttttcgccctctccgtccctctgggtctcaggatatatcagatagcccttgccgccggcgcggtatcgttgatcatagtccttaccgacagcatgagggcgggcggatacgtgataaggcacgtcgactggtccatactcctgttcttcacgggattgttcgtggtcatagccggcgcggtctcgtccggccttctcgattccatgtcggagctgttcgggatgggcgacgggaatgtcccgtcgataggggtgctctccggattctccacggtccttgcgaaccttgtaagcaacgtgccttccgtgatgctcataggacagctgctgccggagggcgacatggtactgtggataaccctggccgtcacctccaccttcgccggcaacctcaccctgatcggcgccgcggcgaacataatcgtggaggacgaaggggagaagcacgggatccgcatggatttcttcagatacctccgtgtcggaatacctattgcagttattacaatcgttatagcgaccgcgtacctctatatgttggatatattactctaaattgctggatgcggattatacatacgggtgtggacgaaagatatttgtcacacttgtatgtataaggtgcaatataccaaagaatccttcaatgtcgtaacagaaataatcggcattaaattacataaaatattatattttaaatatttggaaatcgatggagtcggcatatgtctcacccagtagtggtccgtaaagcctatctcaaccggctttaccaactaagcacgaacagagatgtcgtcaaggtgatctcgggcaacaggtactgcggtaaatccaccctcatgtcccagttcagggatatgctgctgaacaaaggaatccccgagtccaacatcatatacttggacatgagcgaatccatgggcaccatcgacgactccttccagttcacaggtctggtgaagtccagactgtcctcggaggacgcattcctcctagtggacgatatgaacttcgtcaacaactgggacagcgctataaaggacctcagggagagatacagactcaatatctacatcgtcctgccctatgccacatccgaggactaccgcggtatcctcgacgccctcggcaactacgacgtgaccaccctctacaccttctcgttcaaggagttcctggaggcatatcctatcacggacgagcacggctacggggagcggttcgagcagtacatctccataggcggacagcccttcatggacatgagcatgagtcagaaggaccacttcatgatctccgaggggatgtttaacctcatcctcaactgggacatcgggagcaggtccaggatcgacacggtggccatcagcagactcgccctgtacatactcaacaacataggcaacgtgaccaccctctccgccctcaggcagaactccaacgtcaccgaccagcgcacggtggagaagtacctccactacctgttggagtatcagacgatcatgaaggccgaggccgtggacatcaccgacatgaggaggctcggcgtcaaggcgaagtattacaccaccgacgtcaggagcataaaggggatcaccccgaggggggctttcaacatcagccgtcaggcgacgatcgagaacatcgtgttcctggaactcgtgcgccgcggatatgaggtctatgccggattctaccgcggaaacgacatcgggttcatggcgatcagaggcggtgagacgatcttcgtgaaatccgtactcgccctgagcgacgagagggccaaagggaaggagttcaaggcgttcgcctcagtacccgggaagaagtacctccttaccacggaccgcggcatgaacggcttctacgacaacatcgagtacaagaacatcataagtttcctgctcgagtgacaggggttcggacggagggtgagacgtccgtccggtccccatagtctacagcctgtcgaaatataccatattttaacaagggacagtcttggatcgtattgaaaaggaaaggtcatccccttgcggttcctattctcacaaccgatgtctgcgcatgaccatgatcgatctcatcgctcccgacagtacagtatttgtacatctcccatgatggaagcccatggaagaccgttcgcaggcacggaaggaaccgctgttcacacgcaacttcgtgctctgtacggtgaccagtttctgtttcaccatagtattcttcatgttctacaccgggatgtcgtcctactcttccgacgtcctcggtgccggaagcaccgtgtccggcctcgtggccagcatattcatagccggggacctggtcgcacgtctcgctatagggagagggatcggttccataggtcccaggaggatatccatcgtatgcatggccctcggcacggtcatgacgctcctctacttcgtatccgacacagtggcctccatctgcatagtcaggttcttccacgggatgacctacggtgcggccgcctcggccataaacaccatggtcgcagaaggtctccccatgtccagaaggggcgagggtctggggtatttcatgctcagctacagcttcgcctccgccgtcggaccgttcgtctgcatgtacctgcagaacagcgggacctatgacgacatattcatgatcggagtggcggcctccgccgtcgccacggtcacatcggccatgctcaaggagtccaaaggtcctgcgccggtcagggagaggaaggggatacacgtctcggattacatagagcgttcctccctcgtcatgtccgtggtggcgttcgtcatgttcttctcctattcgggggtgctcaccttcatagccccctacgggaaggagatagggctcacaggatatgcgacggtgttcttcgtcgtactctccgtggggacgctgatatgcaggctcttcctcgggaagatatacgacctccgcggagagaacgtcgcactcgtgccgtctctcgtactctatatcgcagggatgttcatgctcgggacggtggtctcgggcgcggagatgctcgtatcggccttcttcatcggcataatgatcgccatgctgtcctcggtggcgcaggccgtcatcataaggagggcgccgaaggagaggtacggcgtggccgtatcgacgtacaacgtgttcgtagacctctcctatgccatcggtccggtcgtcaacggtttcgtcatcggtgccgtcggatacggagggaactacgtcctcatggccgtcataggcgtcgcagggctcgttttgtatctcctgctccacggcatacccgtccacagacatccggaatcggagaatacggggtgagaagatgcccgatgtcgtagacctcggttatttcgagaagggctctgcagagctcgcccgcgatgtgttggggaagatcctctgccgcatgatgccggacggaaacgtcctcagacgccgtatcacggagaccgaggcctattacggggaggacgataccgccgcccatgcacataaaggccgtaccgtacgtacggaggtcctttacacgggatacggacgcgcatacgtctaccgctgctacatgttctggctcctgaacctgagctgcggtcccgacgggtcgccggagtgcgtcctgatcagaggggtggagggatcggacggtccgggccgtgtctccaaagccatggggttctccaaggacatgtacgggaaggaactggtaccggagaacggattatggctcgaggacgacggtttcgtgccggaaagagcggtctccggcccccgcataggcataccgtacgcctccgaggaggaccggaacgcacctctgaacttcagatcggtgtaagatcatctcatacagctgcacgagatgccgccgaaggcccaatcctgccagtccctgagggttttctctgcccaggcgtccgtggcctgcagtgattcctgctccacgagggcgaggacgtaggacagctcctttatggtcgcacccgccttcatcgcctccttgaaatggactttggcacccagttcgttcctggacctcacggacaaggcgaacatcaccagctgtgtcgttttgtcgtcgagtatcatggcggtgttcaggaggtcgttggtctcgtcggtctgtttgtcgaactccgggaagaattcctctatggtcttggacatgtgcttcacttccgtccccggcctatactttcctccaggaatatctttccgtaccatgtgaaagactattctatcggttctgcattcggatgggcatgaacctccctgacaccatcaccctgagaagcatattggggatattcagaatggaatcccatgacggggaataccgtggccgctccaacggattctcgcttacgatcaggccctcggacgggggttatacggcagaggcggtgtccgacagggacggatggggtgcggcggcgaagaccgtcgaaatacccttcacggatgcggactccctcaccgcctctatggagatatggcttgacgggctctgtccgcaggtggtggaggagtatgcggacgacgtccgttatctggagaccgtacgcggaaaggtcgcatattactcatacaacacggatctcgacaccgtccccgtggtattcgtccacggaggacccggaggggaatgcaacccggtgaaggcgaggagattgaagctcgcccaccccgtctacgcctacgaccagatgggatgcgggaggtcggatccgataaaggacttggacagctggggtctggacgactatgtggcggagctgtcggacttcatagaccatatcggatcggacaaggtcatcctgataggggcctcctggggggcggggctgtcggtggcctatgcggaaagcacgggttgttcaaagatcgccgccatggtccttccgtcacccttcgtgagctccagaagatgggcggacgaccagatgaagaacctcaaggcgatgtccgacgggatgtatgaggggatgcggagatgtatccgcgacaacgacttgggtccggaattcaaaaggatcatgggggagtactatgccagatatctgttctgcagggaatgtttcagggatatcgccatagccaatgcggaagagcccttctccgatgtgtttctgacattatggggtcccaacgacatggtatgcacggggacgctgaaggatttcgacgtggtccccgggatgaaggacatctccgtccctacgcttttcatgtgcggggacagcgacgaggtcacggtggagaccatgctggaatacaggggcttggtgaaggggtcgcgtttcgccgtgatcccgtatgccgggcatgtgaccgccatggagcagttcgacctttatagagaaagcatagtcgcgttcctgagggagaacggattcgatgtgtgagcggagtccgatcactccgcctcacacataccaacggtcgctttttaaatcgacatatgtcgatgtcctggaaaacggcacgacatctcaggacggcttcccgatcctgatggccagcaccccgtacctttcgatatcctcgacggagtagtatttctccatgtccgcaggggatgcgtcctccccatcgccgtatccgaggtccttcttatcgaaggtctcatacaattctttgaacgaagggaatctgatgacatccttcaccacgacgacggtctcttccccttctccgtcggagaaccttatcttgtccccgggaaggatcttgcggcgcttctcgtcataaaggcgcatctcgacggtcttcctcccggatacgatggaatcgaacggccccttccttaatcccatggagtgttccgtcccgtatccggccactatgtcccggcgggccttctcgaactcgccgaagaacatccccatctctttttgatcgggggtcttcccccaatacatgagctcgaagtccatgccgtgccacttctccttcacacggttctccatgaaaccgttcaggacatagaacttaaggcggcgttccttctcttcagacccgtcggggaactccatgttgagggtgatcgaatcgggcgagtacctgtccttgagtgtgtccaatgcggccgacccgtatcctttccctctggacccggggtcgatcgccaggtaatagaggtacagcatccttctccaggtgactatgtaggcgaaacctacgaacttctctccgtccaggaaggccaggaggtcggccatgccggtcttgcatccgaccatgaacaagtcgaatgtggaacgttcctgcatgcagaacgcctcgtcgttgagtctctcgacggcatccctgtagggactgtcctccctgacctgcattatcctcatctgcatctcagataccttctgagggaacgcatggaatcgtccatctcgtccttggacaccgttcctccgtaacacaggacctggtagtcgtaattcaggaaatggtatctgtaaagggcatcttcgaagccgagggtgtccaagtaccttatcacggtgtagcgggtgttctgtagcctgtcgcccacaccgggggcgtcaggaaggaggacgatcctatccccttcgtagacgcgggaggcgatacgcacggcctgtgtaccgtatcctttccttctgagatgttcgacgatcgccatatagaggattatatccacacccttgtgcctgagggtgaagaagaagcctacgaacacatctccgtcgtacagtccgatcaggtcgcacctgtcggaaacggccaccaggtcgtcgaaggggatggtcttgcgtcctccgtaggaggccgtatacagcatacgcatctgctccgtcccttcgccatccggtctgatcttcctggtacttagttctcccatcgcatcgcctcagaatatcccggcattatgtacggattcgtaacgttccaccgcatcctgcatctcttcggccgatatcggggaaccgaggtatatggaatcgaaatcgtattcatccgacctcaggagtatccccgggaccgtgcatccgttcctttcgtagaattgtctgcgtttcgcacatacctccggatcggagaatccgcatccgggggtctccatgacggagaatatgcgattgccgtccttgaatttccttatgaggtccatggcctgtgacccgtatcctttgccgcggctttccggcagcatggccagatatacgaggaaggtgaggtccccggaagtgaacatgtatgcgaaaccgacgaatgtctccccgtcgaagaaggagatcatgtcccctccctttccgaaagtgcgtatgagatggcggaacgggaccttctcctgtccagggaaggtcgcggaatacagccgctttatgtgctttacctcgtcgcagcctttgatcacgatcttatacctgagcatcgacagaacattgcgatacatgacataattgtttgcaatggatgtcggatgtacggaggagagataggatgtcgggaggcgaatcgcggcacctccggacatcctcgaagacggtcggggcagccgatcactattctttcgaggcccctcgagatatggtccctgcacgaaccatatcaaccccggaagacctcccttttcgtcttcgtaagatacaatgcgttcatcttatttatatttaggtaatcctaatagatttaatattttttaggaataataaaatattttacaaacaccatatatcatatatactatagataaagggcacagagcagtgtggacgcctcgcctccgccattattaattgcaataattattgtaagtaacgcaattttattaactaatatcaataggatataacgtaaaaataaaaaagatgtatagataatgaacagaatagatggagtacgatgtggtcatcgtcggagcgggccctgctggttcctccgctgcctggtttctttccggttccggtctgcgggtcgccgtaatagagcgtctgtccgatgagaaattcccggaatatcacaggatatgcggcggagggataagcaggaggggcgcatccctgatacctctgaaagaagaggagatcctgaactcggtggattcgatacgtctcagatggccgggcaatactgtcaccgacataagggtgaagggatacgtcatagacaggccgaagctctccagacgtcttttggaggagagcggtgcccaatccatacatggttccgtcacagacgtatggcttctgggtgacatatgcagcataactctggccgatggcagagtcatacgcagcagatatgtcatcggtgcggatggagcgttctccgccgtcaggaaaggggtgttccgtacccgtccagagatcttcacccccatggaagaacacatctcggaggatccgacagaggatgtattcgaattcgacataggtcaggagtttgggggtgcgtaccggtggctatttccctgcggttcgggaagaacggtgggatcggtctcgggaatggtcgtcccggatatcagagaaaggggcctgcaccgtttcatcccgagcggctgtgttccggagctggtcaaaggcaacgtgttcctgataggggatgcggcaggattccccaatccgctcacctacggggggttgagaacggctttcgagtcggcgaggaaagcaaccgaggcgataaggaaaggagacccgtccatctatgcgaaatggcagaaacactccaggcttttcgacagacgcttcatggagctccataacgcgatgtgtgtgatgaaggatgacgatctgagggatttctccaaggccatgacgcatcgcaatcttttcgtcaacggcctatgttccgtcatccggagaccgagatacgccaaggcatacatcggttgcctcatggcgatcctctatgggtggtgaaaaattttctttccaaaacggcctttaaatcgaaaaacaaaggccaacccatatgggaataccttttagaaattataatcgatttaagggccgttttcgtgcaaaatagtttttccatccatacgaacatgtaaaaatagggtcaatttttacaacatgtcgtatgtttcacatacacatgaaaaatatatcattagttaagaaatatgctttattaatattacatgtgcattcgaactgtactttttttgaatatgatcgacatattttcaaaatatcgaatttatcgacgtttttatcatatattccatgatgtgttttatttttacctaattaagttaaatgctttacatatatcatcatatcaaattatgttatttttagatatatttattgcatatttgctttgtatttttcgtgcatctgtaaaaataggcgataaaatccatgttttttgtcagaaaaaaatgtttcagccaaaaataccctcgatttttgtatgattttatgtagatattcggggtaccgtcgttgacaagaattcttgcatttttgacataaaatttgcattttgcactcaatttacgctgagtttttacaaaaatctttattttatgtgaaatttgaatcaaataacatagtattgaattagttaagttaattacttaatttatagaatttatatgatgatgccagaatttagcatgtttggacgtaaaaatggagatattttaagattttaaaaatcgatgcgaattgaaaatttttacccaatatttgtgataatattttacatcgatgatttgtaaagtaatttgcttaatttacataatttatttctatacttctatcgattgtccgaaatcaaaccatgaggaggtatttccacgtcttctgaaaaatactccgaggatctcctaacggtcgaatacaagatcggcacgtccgtatcctttcatcacgagcgcctgcagtctgggaatctatatcatggatacatttggatccaagtcggtgacattttatatctactttctaatcattgtattctggaaaaccaaaaacggccatacgggatcctcatgatgtcatctaagaaaaaattgggcgaactcatctatgccttggaagatcacatctacgacgaggccagcgatgcgttcgaaaagctgtatgatgagaccgatcctggaaaaatggtagaagaggtcttggatatagtccacatttgtaaatgggataccgattacgacgatatgatccgggattatttcggattggccgaatcagaacataataatcaggcttttttccaagacggtaacgagtccctctccaagatctacaaggaaatgatcagggatcaattctgctggatcgggatcctctacaagctcgaatatgatgtgtcctcatatgtatcagacatcatggatgcattggagaacaattccgatgagtttggatttgaaaatgcgataacgtctataatgaaggctcttcgtaaggacatagagaatggagaacccgggaagtggttcagttgatgctttgaacaagcatgcagacatcattcgttgatgatgtactgttcttcttcggaggaatcgccttcgaccttgaaggatatgtggtggtccctcatgatctgctgcagcaatttcccatgtactccgatgccgacattgaggaactgattctccactatggacttcccgtcgtattccgatatcggatggaatccgagggggatgtgattggtctgtacctgcatggcatagatgtgtccgttggtatcgaatatcggccccccggactgacctttcaatcccggagtggatgtctccacatacagcatgtcgtagtttccttccttgctcttgttctgcttcaggacattcctggtgtgtattccgtcgttggggaagaacggcagcggaagcaccccgttccttatgcggaaggatttactgccttcgtcgaaatccgtagcgatattggcgaacggaaaaccggtacggcagatgctggtacccggcctcattgtatcagggtccctgaatatgggatattcctgtaccatgtccggcctgaatccatccaatttcgcaagtgcgatatctatctccctgttcacgtatacgctggtgatacggagaccgtcgcctccccaccagaacgaatggttggttatccatttggggtcgagctgtatggtgtcgggaagtgtcatcgcccccggaacggccatagatgccttgcgggcgttgatctcctccacttccttgatcttcttcatgtcctgctggtatttcacaaaggagtcgaacagatggcctgcggtaagaatccaaccttcgggatttatgataatgaacgtcccgcatgaggatgagacagtcccatcgaccgtcctcgtggatattatgaggggacgcgtgaacttgtacactctctcgcaggccttggcgaacatatctggacaatggtcttggtcctatatgtttatgtcctcacatcggagggtcgggatccctgacgatatggtatcatgcataccttccgtaaataataaagtattttactttactaagtataattatatcacacatacctgaagatcgagtacggagttgaaaaatgtggaggaggggcataaaccccccctttgagatgttttatcactgttcgtcggacagggcgctgaggatctcggggttggatgccacgatggccccgatggccgcgagtataccgtcgtcggacatcatgaggttcagggcgaggtcgctggaaagagcggcctttccgatcttggcggcatagcttgtcgcgaggtccttggcataggacaccttgagctccatggcggcgttctcgtccgccttgtcctcggggctgagggaggggatgtagaagttctgatagagccctaggagttccgcagggagggacgctatgtcgtagaggcttccggtataatcacagctgccgtccttaaggtcttctatgatcgtcttgtatcctgcgatgtcgttctccaggaagtccgccatggccagatacctctcggcctcgtctccgacggcctcggcagctttgtcgttgtactcgtcgagctccataatcttgcgtcccataacggagcgcatgagcctgacctggtctgtaatgctcattgtcccatccattcttaacacctgaatgcgaagacttcgtcttctaaaggtctatcggattattccgtatttaaaacagcgtcgagatgacggctttacaggaaaggataggccgtccgcacatgacggacggcccttgggatcagtatctcttgtctcttctcacgcggaccgctttggccttgcagaacggacactcggtgatggctatctcctcacccttgtcgtcctctgtcatgagcatggggcccatgtaggtctcgtccacgtacacttccttggcgatggccgcatcgagcatccttttgcaacaggccgcttcgatgtccacgtccgagatctccagcttcaggaggggacgggaatcgagtttcctcttcctttcggcatcgatctccccctctatcctgtccgcctcgtcggcggcaccggtgaaattcattcctgcggagtatgccatgaggcggagggcctcgtagaggtccctctcgacccccgctccggtctcgtacatgagggccagatggtacatcgcattgggatccaacgcatcggaggcctgtttcatcagaggatatgccttctcggcgctcggaggtgtcccgagaccgttgagatatgcgacggcgaggtccctcatggcaggtacgaaacccttttccgccgcctgttgcagatacttaagaccctctttgtagtcgaggggacgtccgtccccggtcatgtatgccatgccggtggtgtatacgacctcgaggtcgcctccgtctttgtcgctcatgatgatgcgaatggcaggatgggatttatttatgctggcagggtcactgccttccgagacgctccaggagttcctcggcggtcttgtggccgttgtctttggccatgttgagccatttcctggcctcggtctcgtccctctccacgccgaatccctccagataatagcatcctacggaatacatggagtccaccatcccgtcggaggcggccttgaggaaccattcgaacgacttctcggggtccttcttcagatccttggatccgttgtagtatattatccccagacggtccatggcataggaatcgccgctggaggccgctttctcataccattccctggccttgtccagattggcggtgcatccgcatccggtctcgtagcacacccccgtctgatactgggcgttgatgttgccggcggaggcggcgttcttgaagagcctgaacgccttcgcctcgtccttctccacaccgagtccttccagatacatgaaggccatggagttcctggcctccgaattgccctgtttggcggaggcacggaactgcctcatggcctcctcgtaatcctgggggacggtattgccgtccatgcaggctatcccgtaatacagctgtccttccggaatccctgcgtcggcggcgtccttcgcgtactccaccgccttcttggtgtcgaatcccatgtaatcgccctcgaagaacatgttgaccaggagggccttcgcatcgggattccctttttccgcggccttctccaacaggtcgtatccttttccagagtcctgcccgacggcgtggccgaagaggtacgccattccgagtgcgtacatcccgacaggatcctcctcctcggccatacgctctatctcctcgatgccgacctcggtctgtccctcgtcggtctcaattatgaaccccttgtccggttccttctcgggcataagcatacgccgtccatgaatatccgaactatttaaagtggtgcggatttaccgaccttcgcattaacgggtaggtatacagtccgtatatatcggaccgatatactcatcatacatgctgttcaaatgcggcaagaagaccaaggccacaaagaccgaggccgcggaagcaaagaaggagtgatccctccggggacctttccttcgaggcccgaacccacatccgagcccctcaaacaatttcgatgtcgtccggccggtgtggccggaaagatgttttttcggaaaacgcatctcaatcggacggatccgcagcgtcatagatcttcatcccttccgcgggtgtccgcccttcctcatcagcgggatcttcttcagatacgcctccgcctccctgtacatagggtacagcttctcctggcggtggaactccgggtcatgagggtgcctgttgaacggacggtacccctgtctcagatgcaggcattcgtggtatacgacgaaatcgaagacatattccggtatggatacgtcgtcgaggacggaagacacggcgaccaccctgaacatctgctggcagtatccgagacgggtgtagttgggtgcggacgtccatgtgaaataggtgtcgtccaaatcgtccggcgtcagcaggcctccgtccaggagcctctggaccgcgtcgtagatgttcctgacctttccggtgtccgtacgggcaagattcctgctcctcttaaggaacaccggcctcttctcctggatgaaaccgtccgaggtcgtgtacctcatatattcccctccgagggccgtctccctcccctgtatatggtctatggcagcctccacgaactccaggaggaccctgtccggcgccttgtccagataatcggggatatacaggacggctatcttcttcccgtccgtccgccagcgatacgagaaatccctgttgctctcgaaccccgcttccaggacctccgtcccgcggcgatacgccgcagagttggctatcgccagaagacgctggtcgttttcactcatatgggattgcaacaatctaaaccataaaataccatcccgcattatctctgacataatgtcaataatcctccttcggaggatgttgcgaggccgatcacatgatctacagggacttcaagggactcaggatatcccagatggctttcggcgcgatgcgcctgccgctcaagagcaaggacaactccgacatcgatatggagaaggcggccgaactggttgaccgctgcatgtccgccggcgtcaactattacgataccgcgtggggatatcatgacgggagatcggagacggccatgggggaactcctgaagagatatccccgcgacagcttcttcctcgccgacaagttccccggatacgacctcgccaacatgaccaaggccgaggagatcttcgaggagcagctcaggaagtgccaggtggaccatttcgacttctatctgatacacaacgtctgcgagaccaacatcgagcagtatctggacccacagtatggcatcgtcccctatttcctggagatgaagaaggcggggaggataaggcatctgggattctcatgccacagcaacttcgacaacatggtcaggttcctcgacgcctacggcaaggacatggagttctgccagatccagctgaattacatcgactacagcatgcaggacgccaagaggaaggtggagtatctggacagggccggcatcccgatatgggtgatggaaccgctccgcggagggaagatcgtccctatgacggaaccgttcatggacaggctggaggagatccgccccggcgacgaccccgccgcctgggcattccgtttcctccagtccttcccggaggtcgtcaccatactgaccggcataagcgacatgggtcagaccgaggagaagataagactcttctcgaagaaggaccctctgagcggaaaggagatggagaccctcatgtccgtcgtggacgagatgctgtcgcagaacctcgtcccctgtacctcctgcaggtactgcacctcccactgcccgatgggactggacatcccgtccctcatagacctctacaacgaacacaggttctccaagggagggttcatcgcacctatggccgtgtccgcccttcccgaaggaaaaagacccgatgcatgtctggggtgcgggaaatgcgagaaggtatgtccgcagcagatcggggtctccggcatcatgaaggatttcgtgaagatccttgcggaatacccgatgatgaattgatcggcgccttccggccggtatatcggccggaggccttctgcattaccgatacgggtccccggaataccccttgaacgaagtaacgatgcacaggggtgtgtataaagaccccctcggccgcagatgaggcagtcttctcgggatgcatctcgccggagagtttcgagaagtcatctccctccgacatgatcgcggaatatgactgaaacacgtctaacccgctataactgtccacacataccggatatgtgctgggactaacatgattttgttaacggtcgcaacatataaatcgccatacagaccatattttttgtaaggaagctggattctttaccgaatcctcccccggtccgcattagttgacatggcggaggagacgggaatcttcgtttccgtccataccgccgcccggacatccttcggatgccgggatggcgggctttcacagattcgaatgtgatatcatgaagacagagacaaaagcgatagtcgcatcggcactggtcgtcgcccttgccctcaccgccatatccggtgtcacgtattcgtggttctccgattccgaggatgccaccataaacgtcaccaccggaaccatagaggtggatgcgaaatggtccgacttcactctcaggtcggccaacatcgacggagagaaaaccgtgcacatcggggatcgtgacaccttcccgtacacgagcagcaagttctcctccgccgagacggcatcgtccggcagtacgaagatatccgtcaccgcgttcatgaaccccggagacagcttcgagttcacgataagcgacatcgtcctgaagaacaccatcaaggcggtgttcaactacggatacgagataaaggtggtcgacggcccagagaccattccgttcgtcgtcaaacataccaccgccgaccccgagttcaacgtccctaacataacgtatgcgggctccgacacggccagggaattctccgacaacacgataaccgtcaccctgccgatggattgcggcaacgaataccagggatgctcctaccagatggagttctacatcgtcgcggtacagtccaactcgcccgatgccaacatcacccagtccaacagcggcgccgcggtccacgatgtgaccgcaggcgacaacgtggtggccgtgtcccccgccgagggcgtcttcgattccgcgaccatccagttcaacagcggctcctccgacgggaagatcgtcgtgaagaccgtggattccaccaccgaaggcatcaccgtctccggcggaagcgcaatccttgcgggtgtggatgtgacggccggcggttccgagcacgcgctctgggggaccaacgtcaggataaccttcgtcatcgacggagagctttccgagaacagcatctccatctaccacgacggagcggaggtaacgccttccgacctcacggtgaactctgaagacggaaagacgacgataagtttcaccacgtccgacggattctccgcatactacgtggcggcgaattacgatgcgaaggtcggatccgcatactacgagtcctttgatgcagccgtctctgcaaccgacggcacttccgacatcaaacttctgagggatattgaagtatcatccacagtgcttgtgaataagaaaatttccatcgatctcaatggattcgatttcacaaacgactcggggaatgcattctacatttatggtgggaatctaaacgttcatggaacaggcatcatttcgagcccgagctctgcggcatatattgtaggttccaacaaccagtccgataacaaatatagcgttctgaccataggagagaacgtctcactcatatccactagcgaatctcaacaggctatcgccatcatgccgtactatgactctgcactgagtaagaatacaaactactcttacggagtcgttgtcgatgtgaagggtacccttatcggagctcaatccgtaaagacaaacggtatgatcaagaatgttgataatgcgccctccgtaactttgtctggagcaactgcgatcggaggaatgtaccttgctggctatggagactatgtgatcaaggattgtacattatccggtcagatatacatgaagggaggatccctggagtatgtcaataattacatagtgatcgagtctgagaagtactctgcggattacatatactgtggaaacggaaaattcggcacaaatgcggccatcatgatcgatgactgctccggatacgccggattcggatccattgtcgtcggaagtggcaacattttcgagtatacgggaccctacacaacagaatgcttcgatgtgatgtataacatcaatcccgatgcggattattccgcatctgatgtggagatctacgagagggtaacgaatacaaagaccggatccgacttcgcatactatgtggaaggaaggttcacattctattcgactcagtattcttgcaaggcatacttcacgacacttgaggctgccgaagcatacgatgttgataccttcgtgaccgaaaacggactgaccggcgcaaccaacgtaagtctgtccgtagtcaaggcagtatcccagaataactcctgagaaacccgaataaaacaaaccgtttaacaggggagatatcccctgcatttcttttcaaaacatggtttatattcctataatccggtcgaccatcgaatctcttcaggaattccgacatatctgtggatggaaccgtctgcacatctatggtcccgtccccgtcatttttcgatccgatgtcgactccggcgaaccgcaacatatcgtcggctcaacagaacatcatctgcaggagggtcatctcttcgcagaccgtgaggcggcactccccctccgtacgggagtccctttcaccacgatgtccttctgcacctgtttgagcttggggatgtgttccgaccagacgttccgtctgtcggcgtagtcccttcttgtgtaatacatgagggaggatacggtggaaggggtcggtgtgaatatctgcacctgctccgggttggtcctcagttccgtatggacgaattcgcgaagctcttccatggcccggttcccgcaccccggatgggccgccatgaagtaatatgtcaggaactgctgtttaccgtgtctccgattagatccgtcgaacatgtccttgaaatccagcaggacgtttggtcccggtttccccatgagggcgaggacctcgtcggagatatgctcgggagcgatcttcagctgtcctgagacatggtccttcacgatacaatccacatattcctgtccgtggtcctcgtcgaacacgaccatgtcgtggcgtatccccgaggtcacgaacaccttcctgacccccggaatggcctttatgcgatccagaagggcgatctgtgccgaatggtctatcctcagggaggggcacggtctcggatagaggcatttccggtctctgcaagcacccttctccatctttttcctgcattcgatgccgtacatgttggcggtaggtccgccgacgtcgtagatgatcccgttgaatccggggcgggaggcgatccgctccgcctcctccacgatggaatccgcgctacgggagacgacggtcctcccctgatggacggctatggcgcagaaggagcattccccatagcatccgcgatgggtggttatggagttctttatggtgtccatggccttcacggcaccttcctccgcatagaacggatggaccgcatcctcgtagtccaggagatggacccgatccagctcggcgggggtcaggttcctctggggaggattctggacaagatatctgtctccgtgcctctggaccagaccggatgcggtcgtcgggtcgcagttctcgtagaacatcctgaaagccttggagaacatgcctttatccgcgacgcattcctcatacgacggcatctcggaatatccgtccgggacctccttcccgatatagcatatgccctttaccgaatgccagtccttcccgtccctcatgcattgggccagttggaggttggacagctccgccatgccataggtaacggcatcggccttggcgtcgaagactatgctcctgcgcagggagtcggaccatgcgtcgtaatggaccgtcctcctaagactcgcctcgatgccgccgaggactatgggtctgcctttggcgaacctcctgatcagattggaatatacgatgcaggcgcggtcgggacgtctgttgttgacacctcccggagtgaagtcgtcgtccttgcggaacttgccggtaggcgtgtagttggccaccatggagtcgacgcagcccgcggtgaccgaccagaagagccgagggacgccgaggcgggttatgtcggagccgtcggagacattgggctggcatatgatccccgtgcgaaacccgttgtctatgagccaatgaccgatgacggccgcaccgttgtacgacgagtctatgtaggtgtcccccgagacgatgatgacgtcgagggcgtcccatcccctctccctcacctcctcggccgtggtcggtatgaacatctcatatcctccgggacatgacgaagtcgttggtggcgaatccgtccccctggtcctcgatctcgtgatagaccttgacgaagccgttcctctcgtaggcctcgatggccttggtgttcctcgtgttcacatggaggtaggcagatgtgcacccgtgcatcttcccgtaatccagcatccagcggatcagttcggagccgagtccttttccgcgttcgtctccgacgagatagcatttgctcaggaagagtttctcaccttccaggcggagtgcgaaataaccggccctccgtccgccgtccaagaggtacccgtacaggaacccgtcatccatggcctcctctatgctctccgccgactgccaggattcgaagatgtactccgcctcgtcgggaccgccggttatcatcggcccgaacacctccctccatatggggtgggcgaactcgtgcagttcccgtgctccgtccttcccgatcagctggatatcggccataatgtccacggctatggcgacgcagtacttgtagtctataggtgacggatacccaggacccgctctgttgttttcacagatgtacgacatccggatggaaaacggaccgatatctctgtcaatatcgtatctacgtccagatttccgtcgaacatgtgacggagatccggattttcgacgaagtctatggtcagatgtatttcgaaattctctttgatgaattgctctattatgaaagacttaccgacctgtcttgcccctttgacgactagggcctccttgaacggttcatttttccatttcagaagctcggaatagatctttcttctgagcatgattcgacatgccgtcacatgggctatgatttttacctaggagtttagcacaattttgttaatttttcctagggacttttacctcattttcttaatttttccctacgagttttcttcatccacacaggtccccgcaccgttatccgcacagtccgtatcagggtgtctccgaggtcgttatataccgtgttcaggattgcattccgataacaatgtgcagatattccgtttccgggaaatacgcgaccgcatactccgtccaggaggtctccgaatgaccgaggtcagggccgccctcgtaggcgcctgcggaaggatggggaccatgatcgtccgccatctcatggccaccgagggcatcaccgtctccgccgccttcgatatcgtcaacatcggaaaggacatcggagaagtcgcgggcatcgggaagatcgacgtccccgtctccgactccaaggacctcgcctccgtcctgaaggaatccaagacggatgtcctcatagacttcaccatcgcggccgcgaccgccgtcaacgcccctgccgccgcagcggccggagtcaacctcatcatcgggaccaccggtctgtccgccgagcagaagaccgccatcaccgacgccgtcataaagaacaacgtggccgccgtgatatcctccaactactccatcggggtcggagtgttcttcaaactcgtcagggatgccgccagatacctcggcaacgattacgacgtggagatcatagaggcccatcacaaccagaagaaggacgcccccagcgggaccgccatgaccgccgccgagatcatcagcaaggaactgggcggaaaggagttcgtctacggccgcgaaggcatctgcccccgcgggaaggagatcgggatccactccatcagaggaggggacatcgtcggagaccacaccgtgatgttcatcggcaactccgagcgcatcgagctccgccatcaggcccactccagggaggtcttcgtcagcggcgccgtcatggccgccaagtgggtcgtctcccagaagaagggagtcgtatacgacatggccgacgtcttggcctgaaaaaacctcagaattgcggggacggggccttccggcccctgccccatacaccttttccgattatattcccggataccggatcacatgacccgggtcaattccacttcggtgaagacgtggccttcccccgcgtccttctccttgcgggatacctctctgaagcccatcctcccgtagcgttcgagcgcatccgtgttgatggcgttgacgtccgtgtatgctatcctgtccccgttcttcctcccgtaggcgatgagttcgtccacggtcgacttccacagggcgtcgcgatgttccgcggcgatctacatcttgtttatctggaacatggtcccctccacgcgggcggcgcagaatcccacggtctcgtccccgtccctgatgtaccagaagacgtaatggtcgtcgaacatcgcctcgtacgcctcccgggtggcgaacctgccgcagtagtattccgtctcctccgcccctccggggaggagtccgtcatacgtctcgtgcatcatcctgcacgacatggcggatatctccgccgcatccttcctatccgccttcaacaatgtcattcgcatccctttcccatgtccttcaggagtttcgggatccccgcctcgaaattgacaccgaacctcacgtcggtcccggcctcataggtcctccttatgctcctgtatgtgaaatcgaccgctatgtccgtcgccttggagagcggcagaccgtccattatgcaggagacgaccacggaactgaagatgtcccccgtaccgtgatagtatcccgggaccctctcgctgaacgaatatgtcatctccccggtgaccgcatcgtatgcggcggccccgaccttctccgaatcgaagaacacgccggtgaggacgaccttccccggtccgagtgcggacagtcttttcagtatcccttccacgtactccttggaatacgggccgtccctgtattcctccccgagcatcagcgcggcctccgtcatgttggggagtatcaggtccgccttggagcagagtcccctcatcccccgggggaagtcctcggggaataccttgtagagctccccgttgtcggccatgacggggtccacgaagaccatggcgtccttcccgacctcgtcgattatgttggatactatatcgatctgctcgaacgatcccaggaatccggtgtatatcccgtcgaaccttatgtccagggacttccagtgctccgttatcgggacgaggtccccggtgaggtccctgtaggtgaacccggtaaaccccccggtatgggtggaaagcaccgcggtaggcatgccggagcattccagacctgcggcggagattatagggagggcgaccgtcaacgagcatttcccgacgcacgatatgtcgtggatcgcgagaacgcgcttctgctgcatagggcctccatagtctggacggattattaatgatgcgtccgcggtcggaagaaaaccgttataaccgcgttcgcctacctgcttcccatgccgacagtggacgagcatctcgaacaggccctgagggagtacaatgagaaagtcaacgctctcgaggacggaggctccccgcaggagcttctcgacgcgtacatacaccgcggatgcgtcctgtccatgatcgggtcgttcgtatccgccataaccgacttcgacgaggccatcgagatcatcaccgcgatggaggattccgggacctccgtagactcgggatacttcgtgaaggcctatacctccagaggggccctggagatagagaaatcggtgaagtccatggccgacgactacagggtggcggcctcgcgcctgggggatctgaaggacggatccaaatattacgatacgaaggacatcgcggagatgtgcctcgactgcggatgcgacctggtggacagcgacctggcctcggacgcgataccgtatatcgagaaggccttgtccgtactggtcgggaaggacgacccatggtccaggaacagatacatggaggcatgcgacctcgaaggacaggtgcgtatggacacggaggatttcgagaaggccgccgaagtgttcgacgaatccctgagggtgggggaggagctccgtgccgaaggttccctggaggacataatggaactcgtcagcgcctatgtatccagaggggacctggcggaggatgccggggacatggacctgtatttcgatgtgagggacaaggccatcgccatcatggaggacctgatggacagggacgacctggacgacaccgagctcctggccaacctgcacggggaggtggcgcaggcctacatgaagaggaacgacatgaagacggccgagaaacacctcatgagacaggtggccatcaacctccacggggccaaggactacatggacgggaacgggatcgaccgccatacggactacgggtcggagcgcgacggggacgacgaatgaaggccgtcggaataaccctgtacctttcttatatccagtcccattaacccgataacatgcgcaccttcttctgtccgcaatgcgggaacatggtcatgccgggacttacgcactgccccgagtgcggatacgcgttcgacggcagcgcacccatcaggaaggtgaaggataaacccctgcccatcataaaggacgcctcccagatgaaggccccgtacctcccgtacgagccgagaccgtcccagctgcagatcatatcggacatacgcacggcattggaccagtcgagacacatagtcatagagtccgggaccgggacagggaagaccatcacgtccctcgcaggcgccctggaacatgccaaaccccgcgggaagaaggtcgtctacatcaccaggacgatatcccaatcggaccaggttatgaaggagctccgcgccatatccaccttgaaacccgtgtatgggatcaccctcaccggaaggaacaagtcgtgccccctcctgcaggcgagaccggacttcgaatccctctccccgagcgccctctccaccctgtgctcggacaggaaggcgaagagccagcagaacagaccgggaggatgccccttcttcgaggagacccagcacaacctggagacggtggaggcctactgcaagaagaacttccccaaatcggacgagctggacgtctactgcaggaacatcaacgtgtgcccctatgaggccaagaaggcgctgatgaaggacttcgacgtggtggtggcaccgtacatccacataatcgaccccgacatccgcgagaacttcctttccaatctggacaccgacgagaaagggatagtcctgatagtggacgaggcacacaacataatggacgcggtccgcgagcaggaaagtttctccataaccacccgtctcgtcatgtccgccctcgacgaggccggactgttcaagaagccggaggtctgcgacggagtcaccatcgatgcgttcatccggtccgtcagggcggccatgagggacatagggtccaagtatctcgggttcaacgagaaggagaaggtcatacccgccgattccctcgagaacagcgtgtgcaccgcattgaacatcgaccgcatgcagctgacggcggcgataaacaggaccatcgagctgggggagaagagggaggaggccatcgccgacaccgatgcgccgtcgtcccccgtcctggagttcggaaggctcatggaggcatgggtcaagagtccggccgaccgctacgtcagggccgtcaggtccaacgaggacggcgagtacctcaccgcctcctgcatagaccctaccgacatagtgaggttcatgaatgcgctcccgggcgcggtccacatgtcggggacactgcagcctctggcacagtatgcccgcgtgatggggctgccgtccaattccgtaccgcgcacctatccctcccccttcccggcggagaacaagctggtcgtctacgccaaggacgtgaccaccaactacaacgacctgaaggcgaacccgtccatgtggagcaagatcgagcgcatgacggcgcagatgtgcaacgccgtggacaagaacatcctcgtcttcctcccgtcctaccgtctgatgaaggacatccgcccgtacatggaacagtccgtggacaaacccctgtactgggaggagtccggccgccagaggaacaccatgaggtccctcgaggcgttcaggagaggaaggaacggggtgttcttctgcgtcatggggggatcggtggccgagggaatggacttcccgggggaggagctgtgcttcgccatcatcatagggatgccctatcccccgcccaccatcgagatgaaggccatgaaggacatgttcgacgcccgttacgggtccggcatggggtggaaatacaccagcgagatccccgccgtcaggaagataaggcaggccataggccgtctcatcaggacggagaccgaccgcgggatggccgtcatattggacaaccgggcatccaggaacgcaaggcagctggaggccgtaccctccgacgacccggtatccgatgcggtaaggttcttctccaaaaaatgagcatctgcaacaacaatattggatgttggaaaatccctatatatgatgctccgatggaccggattatggcaatgatgaacgttttgacggacatcagatactgggtcgcggcggccatcgtcgtggccatgttggtcggatccctcggagagatcgtgtccgacctcgtcatcctcgtcctcatgctgcagatgatcgcggccatgcacggcctttccttccataggaaggatttcaaagccgatgcaaaacccatattctggtcgttcgtatcgtgtttcggcatatgcacgatcatcaccctcctgataggtgccctcttcatccccggcaacgagaatctatggtacggctgggtcatgctcgccgcagtaccgtcgggggtatcggtaatcaccctgtccctcatgatgaggggcaaccgtgtgatgtcggtcctggcacttacagtgacatatctgatcgccctcggtctcacaccgcttataaccaccgtcttcatcggcaacgccataagtccgctggagatattcaagtacgtactcctgttcatcgccgtcccgctcctggtgaacgtccctctgaagaaggtgcggataaacaggaatgcgaaggtcgtgttcatcaacatcatgatgttcctcctgatggtgttctccataggcaacaacagggacttcatattcggagaaccggatgtcgtggcactcatactcctggcatgcgtggtgaggacgttcggcgtcagcctcgtgatgatccatatcctgaaaagaaggggcgccgacagggataactccgtggtctacatgggattcgccgtatggaagaactccggactggccacgaccatgtgcctggtcctcctcagcggcattccggaggcgtccctgccctgtgtcctgtccctgctcatggaatccgtgtggttcgcggtgatgaccggatacatcaaaaaacgctggcctccggcgaagagcatacaggaagaggtgcttacgaccggataaggttaataattggttccatctatgggctcgtgctgcgggagtggctcagtggactactacgccggtcttgaaaaccggtgggatcatccctcgggggttcgaatccctcctcccgcgccatcccgttttttggagcaggtctctgaacgggaatcccctttaacaatggattaaaaagtacattgaagtatgtaaaaggaaagacatattcctaacagaatattaaagtcacatacaaattagaaataagaataatctaaatatacgactattatctatggttaagtgagaaacatggcaaagagcagatacgaactcaacaaggaacttgcacagatgctcaaaggcggcgtcatcatggatgtcaccaccccggagcaggcgaagattgcggaggaggccggagcggcggccgtcatggccctcgaaaggatccccgcggacatccgtgccgcaggcggggtctcccgcatgagcgaccccaagatgatcaaggggatccaggatgccgtctccatccccgtcatggcgaaatgccgtatcggacacttcgtagaggcgcagatccttgaggccctcgagatcgactacatcgacgagagcgaggtcctcacccctgccgacgacatatatcacatcgacaagacccagttcaaggtcccgttcgtctgcggagcgagggacctcggcgaagccctcaggaggatatctgagggagcatccatgatcaggaccaaaggagagcccgggaccggagacgtcgtccaggccgtccaccacatgaggatgatgaacgccgagatcaggaaggtccagaacatgcgcgccgacgagctctacgaggaggccaagcagctgcaggtccccgtggacctcgtgaagttcgtgcatgagagcgggaagctccccgtcgtcaacttcgccgccggcggagtcgcgacccctgccgacgccgcactcatgatgcagctcggggccgagggagtgttcgtcggatccggtatcttcaggtccggagaccccgccaaacgcgccaaggccatcgtccaggcggtcaccaactacaccgactctaagctcctcgccgaggtctccaccgacctcggtcaggccatggtcggcatcaacgccgaagagatcaagaccatcatggcggagagggggcagtaaaggatggttacggtcgccatcctcgcccttcagggagcgttcatagagcatgagcatgtactggacaggctgggtgtcgaccgtttcgagatcaggcagaggtcggacctcgaaagacccttcgacgccctgatcatccccggcggggagagtacggtcataggcaaactgctgaaggacctcggcatcctctccccgctccgcgaccgcatcgagaagggactgccggtcttcgggacttgcgcaggcctcatcgtcctctccaagaacgtcatcggaggggtgcccagcctggccaccatggacataaccgtcaaaaggaacgcctacggcagacagctcggcagtttctacaccgaggacggattcgacggcatcgggaagataccgatgaccttcatacgtgccccgtacatcgattccgtgggaaaggatgtggaggtcctctccgaggtcgacggaaggatagtcgcggcgaggcaggggaagcagttggtcaccgccttccaccctgaactcaccgaggacctctcggtgcacaggtatttcctggaagaggtcgcaggactcaggatctgaaaccttcaccgggaccgtcggtacggcggtctcggagattttttatcataattaggaccatcacccgtcatcatgtcagacgaacccgtccggaaatccgatgaaaaccgcgaagtgcctccgcccaaagaccccggggacctctatgtcctgggagggatgtatttccaaggtctcaccgtcccggtggacaaggagaaggcgggagtgctctacaggatgtccgcggacaaggggaacgaagacgccatggtgcgtctcggaataatgctgatgaccggggacggcatcgaacaggactacctggaggcttcgaaatacttccgtatggcggcggacagggggaacaacgatgccaagtacttcctcgccaacctctactccagaggaaaaggtgtggaccgcaacccggtggaggccgtcaaactctgtctcgaatccgcggccaacggctgtacgggggccatggtcgaaatagccagatggtaccgtgacgggaccaactatctggacagggaccttgcgaaatgcatgtattggcttaggaaggcctgcgacgagaagtatgcggaggccctctacgagatgggcgccatgtacgcattcggggaaggggtcaccaaggacgaggagaacggcaggatacttctggagtacgccgccaaatacggcgacgaggatgccgaggaatgcctgaaggccttggacgaaggaagaaccgaaaggccctgatacgtcacagtatgttcaggaacaccgtcaggatcgccgtattgacaaggtctatgaagacgcttccgaccaacggtacggcgaagtatgctttgggggctacaccgtattttccgaacagggcctccatgttggcgaccgcgttcggagtggcgccgagaccgaaaccgcaggtggccgtgaccaacgccgccgattcgtagttctttccggtacaacggaatatgacgtgataggcgaatatcgccaccaccgcggcctgtaccaggagtatgacgaccatcttgcctgcgagatccgccagctgccagagcttggtgaccataagcgccatggcgaggaacatcgacagacatatccagccgagggcacttatctcccgcagcgggagatcgatgttccagtggtccgccgcgttgcgtatgacgagtgccacgatcatggcccccagatagacggggagggttatcccgacctccttgaatgccgatattatgtatgtcccagcacctatgcatatcaccatgagcataagtgccagaaggaagcggttgttgtccacctccaccttggactcgtcctccttctggagctggatgtcctcctgatcaggtcccagacccccttgctcgacgcgtctcttcgccagaggtccgccgatgaaaccgctgaacgccaacccgaacgtggcggcggcgatggccaccgtgtcggcgttcgcgataccgaaatcgttgacgagctgctccccgtaggatgcggccgtcccgtgtcctccgacgaggcttatggacccgagggcgagacccatcttcggatcgagaccgaatatcgtgcagagggcggatccgatgacatcctggaacacgatcagtacggacaccagtgccaggaggaccacgaccagtttccctccctgtttcagcatacggaaggaggccatgaaaccgaccgaacagaagaatgccatcatgaagacgttcttcaaggtctcgtcgaagtcgaattcagctatgtccgcgctgtggagcaggcagttgacaagggcgaataccagacccccgaccacggccgcaggtatgcagaaacgtctcagcgtcttggacttcctgaccagcactaggcccaatgccaatgcgagggcccccatcgcagccgtctggtatatgtcgaggtcgacgccgagcatccgccgtcaatctactatgtgggttataatactgtgccgtccgcggcatcaggatatcctggtctccaacaccttcatcttcctttccgtctccttcaggatcaggcctatcctctcaggaacatggccgtagatcagttcgtgatgcctgcagtacagcgacagcatgtcgtgcacgcaatagagcatctcgtactcggactcgtcccctgtcacgtccatgtgttgttccataggatatgggatggcctgtcatgggttataaaactcggatattacatgtagcatcaggcatgctctttgatcttcttcacatgctcctcgtccatgatcaggctgagggagatgtatccgcaatccagctcgcaggccatgggttccccgctggatatcgatacggcgttctccgccgcatggacactcccgttctcggaggccttcctgaaattctccgccgcatcatccttaccgtccatgccgaagtactgtatgacggccaggttgttcagggcggatccgtcgccggcggccgcggatatcctgaagaggtcctcggatttcttcggagagcacgactgggtcatggaatagaggtgcatcagcccgagagcgttggaggcggtcgtgtccccgctgttggatgccgccatgagggtgctgtaggcgacgttgcggttggggttcttcccgccgagaccgaagcagagcatgacgcccacggcggtcatggccggtacgcatcccagcagggaggattcctcgaaatacttccacgcacggtccccgctcctgtccacgtattcgctgccgtagagcgacagctgccccatggcatacagggccgccggatccttctcctccgcggcctgtttgaggcattttatcgccaggtacgtattgggttcgtccaaccccatccctttcatgtacatgacgtacaggagatagctggcacgcgatatcccctccgtggaagccctggagaaacaatcgtacgacttctccagatcggcgagttcgctgtccgcggcgtatatgcagccgagacagtagtatgctttgaaattccctccggccgcggccttggtgtaccattcgacggccttgaccacgtccctctgtgccccgatcccgtgttccagattgaaagccaggttgaactgtgcgtcacaattgcctctgccggcggagagctcgtaccagtcgttggccgggaacttcgtatcggagttcatcatcatccccatgcaggaatcgtcgaagatgccgtccatgaacttctccctgtcgggaagtccgttcaccggcggtacgaggaataccttcctggacccggaaccggtcctgcggtcggaatcgcactccctgtatctcacggagcaatcatcggtcttcggtacggaatcccctttcttccttctgctgaataatcccatcctagcatcccatcccgcatagtgtaccgtatattaagcggataaacttattcctccatgggtcggctggcatatcggacggatggaaggatggggtcaggaaggaaatcgtctggcactcttccggacggcatcatcccggaccatgtccgtccggacccttatatatggttgtgaagcaccgacatacggccgcagacggattctcgacgatacccggcataatgccgtgaccgctcccctcccatacaggaatgtgaatgcaccccttcgaccttcggccagaagaaggccttgaggaaagggggagttcctgatacccggacatcttctcgatcccgggacacatccgtcgcgtcgtccatgtacgggaggtccacggcgatccgcatatcgatgtaaatgaagggaacttcctcaggatgatgaccgcggacgaagtctcggagatgtcctacggcaacttaaaaacaaaaaagatgattacaatactcattattgatatgatatgttgataatgggtattatgatactcttttataccacagatttgatgcatattcatgaaagaggtcgagagaacacagtatcttgaggaactcgacagatggaaggacagccccgacatcgtgaaagtcatcctgggtgtcagacgtgcgggcaaatccgtggtcatggaccagcatatgaggaggatgatcgaggctggcacagacccgaaggatatcctcttcatggatttcgaatcctcggatcatgacgatatcaaggaccatggggatttgaacacgtacatcgcagaaaggatcccgaggaacaggaggacatatatcttccttgacgaggtgcagagggtcgaaggatgggaacgcaccgtcaactcgctgatggtggactatgatgcggacatatacattacaggttccaatgcgtatctgctctcgtcggaattgtccacgtacctctccggcaggtatgtggagatcaaggtgttcccattctccttcgcggaattcctggaggggcatccggcattgccggatgccgacaggaacttcaggttccagcaatatctgcgcaccggaggcataccccttaccgaccccgaccgcggggacaggtacaaccgcatgatcctggaggggatatacaacaccgtcctggtaaaggatacggccacgaggatggggataagagacctatcgggactggaccgcatagcgaggttcctcatggacaattcggggaacaccaccaacgtggataacatcgccaaggccacgggtctggccaagaagaccgtcgaaaaatacatccgttccctcgcggaagcatttttgttctacaaggtcgagagatacgatgtcgtagggaagaagctgctgaactcccatgaaaaatactatcccgtggataccgggatggcgagagcggtgctggacagagggatatcggatacgtcgaggcctctggagaacatcgtgttcctggaactgatgcgcaggggctaccgcgttcgcgtgggatccttcagggacagggaggtggatttcaccgccgagaaggatggcaaggtggaatactaccaggtttgtctgacgatgctcgacgacagtacgttcgacagggaggtccgttcgatgaaggcgatagacgacaactatcccaagaccgtgctgtccctggattccgtagtcagggacatgccggacggactgatccacaggaacgtcatcgagtggctgctcgggtgaatgatacgatctgaatacgatagatggaagtcatggacaatgaaatacgaccgcgtgatcacaggcatcttcgaaagcagaccgaacaggtccatagcgatggtggagatcactgacccagataccggaaatgtgtacgtttgtaagtgtcacgtgaagaacaccggtacagtttatccggaatgatttattcctgccagtccatcaatatcaagtaacacagttattttactgcccatactattctttggttgtggccgacaatcacactcctgaacaacgtagaaaaaacatgcaggcgatcaagggaaaggacaaagaaacctatcttgatgcttgcgtcgaatacgatagaagttctcgttcgataaacattgtcgaattgtcgtatatctattggtgacggatgattagccgtactgatttaaagttagaatacaattattcgaatagaggaaaatgctgagtgacaaaccgatttgcagcatagaacaggaccgccttaatcacataatagtggtggatgcaatcgcttctgagattgattccattggtaaagactgtgccataatcggaatatgcggcaaatggggcactggcaaatcctcggtaatgaatctccttttggataaactaccgtccgaaaaataccaaacgataagattcaacccctggatggtaagggatgatgtcgatataatccggcgttttttcagtacgctggaatcttcattgagcaaaggttcggagtgcaaacgcaagatcaaaaaagccgtcaaagaggttttgaaaggtgccgccgagaaacatggcggatggccggctgttctggtaaaggcatactatgagactgttagttcaaacgatgaagtcactgaaatgtttcacataaaaaaggccataaaccgtagcctttcgaattcacagaagaagtatgtggtcgccatcgacgatatagaccgtatggataaacatgaaatcgtccagattttcaaattcatccgcaatgtcaccgacttcgacaacatgatctatctgcttgcttacgatgacggggtcgtgtcgggtgcacttgccacagatgcctatgatggacatgaataccttcaaaaaatcgtcgatatgccgatctacctacctgatgcatccagtaagaacatagaatccatactgagagaggatttcggccagataaccggaatcagaccatcggcggaggatgtcaaaaacgaagatccccacatcaagatgagtcagttccgtgtgcccggtggatcggcggaggatatcaaaaacgaagatccccacatattcgatgagatggcacaccttttccccaacatcattactactatcagagaagagaaaagagtgattaaccagttcaaaacaaagtacgtcctggccaaggacgacacatcctgctacgatcttctggcattatgcatcctggagatgaaaagacctagtttgatcgactggattaaggagaattcgtatcttctgtgcagggatctttcatcacctgaacaatcgtcagatagggaaaaactgtacgaatcgtttaaggagctggatatagacaacagcctcagggatcttctgcagtatatgttcccgccctcgaacaaggaaccggtgttagaggcggtaatgattgcaaacgcaggtctgaataagaggatatgccacagcgaatttttcgacaattacttccttcagattcccgcaaacatgcatatgccggagtcggaaatggaacacatcctgtcgctcacctctcctgaggaaatcgaacagatcctgtgcagatatgaacctgaatcggatctgctgttcgagaaactgtcaacatgctacatcctgaaaaaaagcgccgatctgccgacggtggtgaggtatctcctgtgcgataatgaattggtgtccagaccgaggagtttttcaccgctgattcatgcggagattagatcgattgtggataattattgtctgaaaaacagcctcaacaagaccgatttttacatagggcgcctgtcaaaagtaagcatcgactcgatgttccggttcttcgtaatacttgagaacagcggtatgttcaaaaaggaattcaggagcaaggatgagattgataaacttgttgaggctgtcgaaacaaagatagaggccgaatatagtagctaccccaatccattgagcgatccagattactattccatggtctcgtatctttatcagaaactcggagaggtcgatttatctcgtaaaattcacaatcatttcatcagcacagaaccagatgtcgatgcttttctcgatgtgattggcaaactgcatgatgggtttgacggagatttagtcgttcatttggtggatccagttttaatggaaagggcgcactacaaagaaaaatacgatgaaaggtattaggattgagcatatctcttctctaagagtacgtttctcattttaggtagcaacgttgctaccgcctttattatatcgacaacgactattaaccatgcttgatgaaatacgtcaagaccgtaaatcccataactgcggacggcaggaagcgtagcctctctgtcgggtacgcgataaaggtttggcctcaacgtaggcgacaagcttctcgcataccttgccaggcccgaggatgagttcgagattgatacctttctcaatggtaccgggaaacagtactacatcgtgttctccgacaggacggacataatcacggcccatacctttgcacaggccgagaagatcgccgctgattcatacccggactgcaccgtcatcggcagactggattcccgcgcacaggcgatacgttgccgcgacatcctaatcgccgataacgttccaaaggaaaaactccaggaacgtcttgagcagttaattgtcggagaatgatcttcgaacgaaccctatatcccataccctctacacaatccaagtcggacctatatgtcaaacccctacatcatcgtcatctcctgcatcaccacggagaccgtgatggtctcctccccccctcgatcttctacaaggcggacgaggtccacctgttccgttacatccgcgatcccgggacacccagcgcgaagctctacgaggaccatttccaatcggtgtgcattgttccggagacccgtaagaagttcgatacaagaccggggacattttttgaggctccgacctcgtacaaaaacttaggcggttatcgaaatccaagaccgacatcgtccagcggttttgaccgagggtttaggaaaatggcatgtcgggaattcagactcgaccggatacgggtcgtattttgtacttcgttagcgaaagccatattccgttgatcgaacatggtcagcaagagactgctttttaatgcaggaaaaatgttattcggcaacggaacctacaacggagtctcattcaaggtcgtaccttccgacataccttcgggagaggatgcaccggaggccgtggacctcactccgatcctgaaagcctaccagaagctcctcgacaggatatactggacatccgtttcagcgaacaactccgcctcggcggtatggaacatctacgaccgtgcggaccggaaggactacggtgtcacgacgctcatggcaagcaacgtctacgattccgtggttctgtcggaggggatgaacgaaatactcaccctctccgccatgcagcagctcgctacctactacgatgccaacggggacgatctggacgatctccggataggtctctacggaaacggaatggacgctcccttcgtcagaggatccattattgatgagttcggcaacaaggtgtacgacgacgtcatcttcacgccgttcttccagtccgattccgtgaccctggaaaggggaatggaccattccgtgaaacagaacaccctggtagcggtatggaccgacggcagggacctgacaacgtggtatgcggatgccatgcagaccgacggttacgagacgctgttcatcgaagaagggtacaccctccggatctcccagttgggtatctgcgacgataccggaatgcacaccgaacccaaggtggaattcaaggtaaccaaggtggactacgtcagccccggtcttgcgaaactccacaaggaccacgatgccgatgaggaaaccaagaactgggtgaaggggatctgcatcgccatcggtgccgtcctcgccctgtacggtcttttcacccgcaggtacgtcctcgtcatcggcggtgccgccctgatcgtgttcggcctgttcttctcggattacgtggtgaactggatcgcagggaaggtgaggttgtgaattttggaaagaacgaatcggatgactggccggtagtggattcggcggaggatgtcatcagagggctgaggaaacaccggaatccgatgacattagaaccctgtcaggaatgcggcatagggcagagggtctacgctttcgggataagcacctgccccgactgcggggcggggatcatcccgtgctctatgtactgggaatgcagaacaccctgcgtttacgaggaaatccgtaacgcgggaggaggaaaaggaagaaggagaaggtaaaaagcatgagagcgatagggaagaaagaggcgagacgtatgttcggcaggttgaaggagaggttcggcaggaagaaacagccgacggcatcctacaaccgcattgaagaatacaacaggtgcaggagcaacatcatgcgcgtgcaccacttggtaatcgttgcctctggagaagaaagggaagtgggccttgaagatgccgtaatcagttccgccgccatcgacggactgtgcgacagaatcatggactgccctgactggttctccaagactgcggtagccatcgattatatcgccaattttcatcccttcgttgaaggaaacaagaggaccgcactccagatagcgatccgtctcctcaggaacggcgggtacgaactcgacgatgatgatgagacgtatctgttcatcaggaacgtggcttcgggaatgtacgacagggaagaagtagaagactggctgaggtgcaatacgcacatcagcagtctttgagttttcccataacgtaggggtaatcttcgatgtctttgaggattacctcgtcgggaatgtcgtattccagacctccgaaaggcgggattgccttcgtttcggtcttcttatcggatttcccaaacatacctgtaacaacccactgcggtcttataaaggtatcatctggaaaaccgccttccccgctttctgccggtaccgacttcgtcttggacgagggaccccgatacgctggccgagggggagtacgcctacgacaacctgtcaagtgcggacttcgtcgtcggtgatttcccgttccacgagttcgtccagcacatctcgggtaaatcgagttacgacatgatctccgggataaaagagttctacgaagctcttgacagaggagagatggaggacggcacaccggtgcaggatgcggataaaatacgctacgagtacggaaagattcttgcagtcaggatgagggaggaatacaacgtcccaagggaaacggtagcctctttgttttctgtgtcagagaacacgatcaccaattgggtgaacgcctggaagagttcccacccctcggtataaaacaacttcgattcaacacgtcaccccataccgttccgtgaaggatcgggaggggtgacgtgcccaacttggtgggtcaaacatcctcgccgggagcttctgaaatcctctgaaaacagggggccccaagatagatatatacgcgccgcgcgaggcagccgatttgtttgttgtacctgtgtctggcctatgtgtcggaaacacaatcgaaatcagatcagttcgtcgggattttccaccgtgtccaccacaattttacccgtaacccggttccatcctacacgcaggtagacatcgcggtcgagattgacatttgtggtgttcttgcggatgctcgatttgaagaaaatactgtattctcccttgtcaagcgagagcttcagtttcctgtggacagggatgctgcgttcaatcgaatctccggttttcttgccggattttccgaaaagaaccttctctgtcttggtctgggtattttttgttattgtgacctgcatatccggtatgacaacgtatccgcttgcttcgtactcgatggtgagtgtggatttgttgggatccgtgggcatatcatttccattattctggttgaggacaatcagattgccgcaatattcgcaggtaaatgatgtgccggtatgattcggagggattttcgctccgcagtaaggacaggtcagtgccttgtattccatctgatccgttggtaatctccgtaccactattgaaagtgtcgtacgggtccgacctctcgcctagttttatatcggcggatggacataaatatctgaaagcacggaggcatcggcatgttcacgggaaagaaaaaggagatcggaatgactcttgatgaactcaggggcatagttgcaccgattgcctcccgttacaacgtaagacgcgtctatcttttcggctcccgtgcgaggggggattacaccagggacagcgatttcgatttcttcctggtgcttgattatgataaggtcacgctcaccgaattgggttccttcatgaccgaactggaagaggctctcggtaacagggtggacttcgcctacgattccgcaactgaagcattcaagacccgcattagcgaggatatgaggctcatatatggttaaaggcggaagggaactgggcgttctccgcgataatctggaatggatcatccgttacgcagaaggaatcgaagagtacaggacgtacttcggggatgatttcgagacgttcgccgataccgaggtctatcaggacgcctgctactcgaagatcaaccagataacgcagtgtctggaccgcgtcgcttccaagtatccggagttctatactcagaacttctccatgccaatcggatccatcaaggggatacgtaacatcatctctcatcaatacgagaatgtggatgtccgcatagtctggagattcatgacggaggaaatccccgtgtgggaatccgatgcccgttctgcgctgatgcgtatcgacgatggcggggatcacagtcttaaatcacctgccaccaagagaaaaggcttcagagaacttttccgcaaacattgaccgtcggttccaagtgctccgaacggattccatccatgaacagacgcggttgtctccggaacagattgtgtatcagggaccgacagcgataggcggttacctaacgttattctcaggcattgcccgacctctcccctaccattaaatccctgcaaatcccataatccatcgcagaaacgacgggaatcctcaaggagtgaaaaccatgaggaatagaaaaaccgccgaaggtgacgtattcatcgccaccttcaacgagaagaaccgcaccgtatccgacgaccaccttacgatgattttcgcggccgtcggagcaagacacggctacgaggatgtcggagccgaattcgcagccctcgaagatttcaaggtcagatggcagaggtcctacaactggatccgcttcaccgtctccgactacctcgacagggcgcccgatgacgtactcggtggatgatgcggagaagcggaagttcatggccgcgttcaaggaactgaatccggattggaagcctgatgaggattccatcctgtacgatgagggtgctccgtacaagggattcctttaccagaaggccttgggaagattctgatttcttatggttctgatcatcgataccgagactacgggtctttctggttatccgaaggacagggtgctggagatcgggattgcggagctggaggaaggttccgtgaaacccgtgtattccgagataatccgttattccgatattgccgaattcgacaggaagtatgtgaacccggatggttcggaagggatatggatctacaggaattccgacctgaggatggaggatacactgaatgcttccaaggatctggagacggttgccgcggaggtgagggggatcgtctccgggagagaggtcacctcgtacaacgttccgttcgatttcgggaagttcctgtaccgtgaaccgtggtgcctgaaggagctgtgttccgttccctatgacatcatggagctggcgacgaagagggtgcattccctggcggaggaggatatgattccggataaggcgcttcaggagaggctgctgagggagagggaggaatcgtactatccgaacaagtggatcaggtcgatcgatgcatacagggcgttgtgtcccgaggattccatgggattggaggggatgaggcaccgggcgatcgatgatgcggtgatggaagggtggatactcagaacccttctcaaaaactgaaaaaatcgtaatccagcattagttttgaaactatttacacatcaaaaaaagcatgtttacacattatgtaattgaaattctataacagtgtaaacttaataaactagaacaaatattgtacaagcatgaaggaaattctttcgaaaatcggagtagatatatccgaactagcccgcagatttgacatatctaggccgacagtatacaaatacatcaaaaactacacagagggcaataaggctacgatcccggagaaaatcaaggcctttttcgactttgtctccatcgatactaaccaaaacaccgatgatgcgaagaggttccttttgaattccttccctacttccgctgaatcgggaatcgttgaaaccgatcaggccttggaatcgattcttcaaaagttctgtgatgagaagcagacgaaagacaatttcctgtcactggttttgcctactggttccagaaagacaacaagcgtcattcgctttattaccgactacatagcaagcggcggcgaacgcaagatattctttattactacattaaagaagaatctgcctatcaacattgaagaacccgcagaggatgtgctgagaaaaagtttcgatgaatatgggataggtgacctttacgacgaaagggtgatgatggtagattctttggcgaatatgctgctcaagaactatcctcttctcagtgcccccgataagacgaactgtagatccatcatgggtgagaaaagaatcaccgaattgaacgatcttatcagctctcttggtgaaatagacgaatcggccaaagcgtacaaggagatgttctccaaattcagggaattcgaaggtgttttcagaaaagcattggttggaaaactagaatatctttctagggatcccaaggaaagaaaacgcatcgtcaccgaagaacgcgaatggaaatgggtccccaaactctatcccaccgtattcaccgatgataaacaggttttccttatgagtatggcaaagttcgtgagtactcacgacaccatagtgaacggtcgctattctctttacgattctaaattgattgacaattcgttcatttttatcgacgaattcgatgcaacgaaagagaccgtcctcgaaaggatcatcgatgcagacaaggacgaagcggattacgttgggatattcagacgcatattcagaacattggagcataatcaggacatctggaaggaatactaccgcaatcccgaagatgatgaagatggaagaagaacagtctccgccaaggatgttctcgaaatcaaagagagagcggaggcactggcaaaagactacaatctcgaatgcgatttcaaacttgccgattccgaaccgcttacatacatcttccgtgacaacaggataataaaaaccggaaagaacagagagttcatcgttgagtacgatgaagtggaaagaatcaatctcatccgcagcgtgaatgctgaagaggatcaactcgaatacaagagaactattacctcgatgttgggtaggatgtatggtctgttcagacatttcgaggcggttttctacatattggcactcaaccatatgagtgttcaggagtccaaaggaaagcccctcacacgcgatgcagcgatacgcacgatgctggatccatatgatttcaacgaggcacagacaaagtatctggttaacgcaatcaagttcagaccacccaaaagagctaacagcagagaccctactccagatacttccttctacgaggcgggattcgaattcttcaatttcgtagacaacgataatcacaatctctccaccaagatattctgtacttcggtcaagagaacacccgagaagatgctcatgcgcacactcgacagggcgcatggggcaaaagtcgttgggatatcagctaccgccaggctgcgcaccgttgtcggaaactatgatttccgctacctgaagaaccaggaggatttctctgagtacaaaatcagccagcaggatcgcgatcgtctaagggagatgttcgccaagaccgtggattgctacgaagggcgcgtcaacatcatacccaaacttattgacagcaggtacgatatcaaggagataataaagaacaagaggacagcggcggatctgaaagactatctgggtcagtacactggtaatgatatttacatagcaaagaggtatctccgcgttttcagggcattctatgaattcatcaatgcggaggatgcaagatccctgctatgtttcctcaacatattcccccgtgaaaaaggatccaacagggaagaaacgttcagtgccgaacttctcagaaagatcttcgttcagattatcgacgattacactgaagggttgacggcatcgggacgtgtagtaccagactatctggaaaagatgaaaagcgaacctttcgtcacaataaaatcggataacttcgacaaacacaaggaaaatcttctcaacagactttctaagggagaaaagattttcgttatcaccacatattcaactgtaggtgcggggcagaaccttcaatacaagattccatcgagtgtagttccgaacataagatacatcagttctttggcggaaccatcgaaggtcgataagaaggatttcgatgccatctatgtggatatgcctacgaatgtggccaagaacattaaggagaaagagagactggatctcctctcctcactgttcgatattgaatcccttcaggaaaaccacgagctggatctgagaggtgcccggaacgagatctccataagattcgctcagtactatggcgctccccctactgccaagcgcaagaaggcgatggaatatccgagttaccgtatggcctatgcgcgtaggataattcaggctataggccgcatatgcaggacatttgccaagaattcgaatatctatatcttcgccgatgatcagttgggagaggtattcaaaggcacatccataagggatttcgccgaccccaacgaccgcgattccgatctggaagaggtgatggcgaatcccgaattcaaatgtcttctcagagagcttcagaattcatccgccaatcctaacgagagtgtgctgaaagaactcttggataatgaatctgtaaagacccaggcatacatagattcgatgctcaggaataaaacatggtccaccagttccatgaggggatggaatagcattcgcgaatatgtattgacgttccccacactctcggccgattctaaacttgacatggtctacaatatgtatcattccttcgacaagccggcaaactgtctcagataccgccaggagaaggactaccatgaagtgtatatcgatccggaaggagattgcgaggtctccgaagcggatgcgagactggcagacttcctgaagatcccaagcgtaagccctatgttcggcgaacccgaaaccgcggactatgaatcaatgccatccattgatgaattggaggtattgcattatgctaatcatttcggaatgaatactgcgattatgtgtcccgcactctaccacaacatctacaaaggcgcactcggagaggtctccggtaaagcgattcttacggattggggggtcgaagtgaaggagatagaagacccctcgaagttcgagaagttcgattatgtttcgggaaacggtacgtacctggatttcaaacactgggccggaccgggatcgttggataacaagaaactgatagagtggtcgttccagaaactgaaaatgatcggggggactaaagcaattatcgtgaatgttctgaaaccgaaggattatgccggttcttctatcggatacacaatccacgggaatgccgaaacatacagggaccgtaacggagagattatcgattgcactggattgaccataattacagtaccttacctgtacgattgcgacaacgaaactgccaaggagaatttcgaatctagaaaaacaataacaaaggaggcgatttgatgggaagaggaaaaaaggacgaatcagaggtaatgtggcctatctacagccttctgaagtatggcgatatagactatgatggcctggagaaagacttcacctgggcagtggtaaaatgcgacggagcgagttcgatgttcaggctacttcgtatcgtcaaaccggccgaaggcatccgttccctcaaaatcagcgggtggaacgagaagtcgacggtccacatcatggccgatatcgattacgatgatgtggaaaccgcgattgtgaatgcaatcggttcggaggatttcaaaatccattacaccatcgagaagatgaacataagggatgcgaaggaaactcccaaaagggttctgttccagctaatgctcaattcgctaggcaacaatgtgctggtggatgccagcaatgcagaggggagtttctataaggtggtgaaatcggagaacacaagtgatctgaagaactttgttgcaagatacatcaccctcgaattcaagatttcgaatcccccagactacctcggatgctactctgatgttcagctcgattacaacgtggccacattcaacaatgcactccgtgagaaaatcaattgggggaagaaggatccgaaaatctacacgaggttccgttacatcaaaggtgcggggatgcagacggcatccgtcaaggaggatgacgggacaacattcgtgaaaagaagctgccgcctcgatgacaaggtccacctagatatgctggattacacacgttctaccaacgagtccgattcggaaaacgatgacaatctgatcgaacgcaacctggaagaaagcagagcaaagataatcctggatgtcgtaaacaaattcaacgatgtttacggggattacctcggcggcgtttccctttacagaggtgaggcgattcgtaagaagacctctctcgacgaatcatacgaacagaggcttatggaccacttcaagggagaaacgatcagggtttacaatctgacgaaggacaaagcaaacgatgccgtaatcgaggaattcatcgcattggtcagggaaagatacggcgtggatatgcagttcaccacaggccccagtctggtgggtttcaacatacctgtgattcttcccaagaaagcatacaaaggcagagagaaagaggatccccacacggacgagagctacaaccttcttcagcacgttgtcataaacaacctgaaggaagcaatcaggaagtacaagtcggaaacgaagaagaaccagacgatatacaacaatacgagggaaaaatgggttaagaaagaagagggccgtaaggcggaggattatcccaagaagttcccgactccggcgaatatgcccttggccgaagttctgttcgagcagctgtatatcaaagaggagatagacaaggggaaaatggagttcttcagatgggcagaggagtattacgagggaagatgggagttcgcgatcccgcttacgcattctgaacacaggaaggttcattgcgatggtttcgcagtattcgaagttgattcggacggcactatgactgaacccaagaaatacgcgcccagcgatcctttcggaccgagggggtactccggaatcgattggaacgaagtggagtatgccgttaaagatcctgcggggcagataaacgtcgtcagaacaaccggaataagtacaatcccggatgcagatgcaatttacgacctgctcaggaagaatcataaaggaaataaaggccgtactgtcggaatgaaggacggcaacgcaaagttcgagatgttcggcggcagtatcgatctgggttatgcgaagttgtcgaagagcagatggatctattatgtcggacagatgaacatgaagatgactgtggcaaattcatccgtggtccgtgagatcgaagccctcgatgaaggttacgtgttcttcgacagattgttccatatgatgtcgataccgtatgtgaagcacaaacagaattcggtcattcccttcccgataaaatatctcacggaatggtgcaagaaactacattactttgttgcgaacatcgaagacgatgacgaagataacacagatgaatgaacgcgatctttaggtcaatcatgctcttggtaaatgatccagattacacggcttgtgtccccgacggtagcgtatgggagcgtattggcacctttctttggtggagttgctacctagggcctgcattcgatagagaatgtgatgccccctgggtagtttcaggagaggctgctgagggagagggaggaatcgtactatccggagaagtgggtgaggtcgatcgatgcttacagggcgttgtgtcccgaggatccgatgggattggaagggatgaggcaccgggcaatcgatgatgcggtgatggaagggtggattcttagtgccttaggcttacaatcaccgtgataaccttatcttgcagactggacaaaatggagattgcacctggaactcgattttcttctggtattcgtgtccattggggcacctccaccaaaccaatctgctactgccgcgggatacctgcgttggcagtagttccccgttcttttcataatcccaccaggtcatgatttcaggctcaacagtggagagatcgttatatccttccaaaatgcgcctgtttgcacaataggggcagtttttgtaattggaaaaattgtagattgttgcctgatatgtatgacctttatcacatttccaccagactttggtatcggaacctttgtttatctgagtaggttcaagaggtgaatttttctcatagtcccaatactcaagaagatcaggatttgtagtggcgatatcgttgaaaccaggccatactttacgacccgaacagtaaggacaattctggccatggctcttatcgcctatggtcatttggtagctgtggcctttctcacacacccaccatacttttttcttggaaccgggcctcacttttttaggatccaaatcattcttttcatagtcccactgagaaatcaaatctggacgtatcgttacaatatcgttgattccgggtgttgcagatttcctattgcatatcgaacatccagatgaaccgatgtgatccctaacacttcttaaagattcgtgcccacagggataagtcagccacacttttctatggcttccagcagacagtgaagaagggtcgattgtgtttttgtcgctccataatgcagcaatatctggattagttgtgcaaaggtcgttgaatcccttccataccttacgcccagaacaatacggacaccgcgacccggttgaaatattggcaacagtagcttgccattcgtgacccttttcacagatccaccagagtttcttcatcgaataggtattcacgtattccggattcagggcaccgttgcgtttcttgttccagtatctgatcaattccggttttgattctgccaatgaattctccttacttgatttgatgtagctttcataaatcacagggcgatcctgatcaaggttaatggtaggaactttacgtttcctagggaatatcagtttaataagtttggatatggcagctgcgaggccgtcatcgttgcggttctccattactattgtcggataatccgaaatggtgggacaatttggttcgcggatacggattagaacaatgccagtatcttcgcattccttattcttacggagatccttctcaactgacctgtgataggcttcaccgtcatattcgacagcgattttcagtttcgggagatagatgtcgagttctttacgggatttcaaaggatgcgctgattcctcgacagtagttatcttagacaggtagaatgcgattgctttctcggcaaaagatgtacttctctccattttgcaaataggacacccagacccatagacacggttgttgggctgtgttttccattcatggccgcaagggccgagccaccaaacggggatgtttgaatgaggggcaatcttatctggacgtttcttctggtttttggtcggatgccactctttcgcgagttctgggtattgtgagtctaaatcattgatcccgggtacgataaggcgatccgtgcatatcggacaaccgtcgttgaagcgcctgttgttgatttgtgctttccattcatgaccgcaagggccaagccaccaaactttctgtttgctgccataggtaatatcggatggcttcagcttaccgtttttggtcggatgccattcttttgcaagttccggttctttggattctagatcgttgaatcctctgagaacctttaaaccatgacaatacgggcaacctctacccatccgtatttccactggggaggattcccaggagtgtccacaccgtcccttgaaccataataatttccttgcaccgtaagatacttcgttcggagatatggtgttcctttcataatcccacatctgcagcatgtcgggattgttttccagacaccatttttcaaaagacagtttgatattttcaggtaacactcgggtattggaagtttttcgatattatttagctatgtttgctttgaaccatatgaaaagcatagagaaatagaaaatgtgggagagcgattgcacaatcccttgaagtagatcaggtcgatagactcacacctagcattctgtctggggttacattggattaaagtgtgggggcatcaggatattaatgccaccctcgatgtagatacacgatccatttatgaggtaaatcatgagttcttcagacctttttgacagggattttacaaaacctactcgtttgcgttttgttcgttttcttaggattcctaagaatttagttaccttttgatgcttcaaacgagtattctggggcactgcgtttccaattattatcatgttttgctcttcgaaggtgataaaattgttcacagatgttttatttatctgaatttgaattttatcttgtagcgaaaaagaggcaatatgcaccagaattcatcgaatacatggagaacataatccatcataagaactacaaaggcctagcaattcgtaaaaacaaagatggtgactggtcctggtgcgcagatgcatccgatgtacgtgaaagtcgtatcaaatgggctgaagaaaagaaaaaagaacttggaatttacgatgataaattcgtatcattgttctttaagatccatccaacaaaaattcatgtttgtgcagtttgtggcggttccgcgagaatcgaatatgtatacctcaacagtagcctgataaaagctattcaaaaacagttttcaatggtttttgaagaaacagatgatgtgcacgacgttgttgaagaattatctttagagggtttttctgaaccagaaatcaaacaattcttcatcgaacggttcaaactcgatatctcggacacactcgattgcgatgtaattcttacaatttgtgaatatcgtgctcgcacaggcaaatccaaggatttaggccccggagttatgtctaactttccagatcgttttgatggataccacacatacaatcgttgttgtcggcaaactgcagataagggtcgcagtaaagacaatatggcaaaatatgggagagattgtagagcatacgaatactggtctgacggaaatattgttgcagcccttcctcttgatcgtgcaggtcttcagatcgccttcgatatcggcggattggttgtagcaccttatgggtcccggtatcttccccaacctgaggaagatgaagaccgcgacgaattcggtggatgatgcccttttcggatgacccgccgaaccgttaaactaattatacccccaaactccattactccgatgctgacatttgctagcatcgggggattttctcaaacaggatgtctccctaggctgctttgcctgagcaacatgaagaagagagttgatgaagtacgaccgtgtgattcaggggacattcatagacaggcctaaccggttcatagcgttggttgaaatagctgacccagttaccgggcagagggcagtttcgaggtgtcacgttaagaacaccggcagatgcctggaacttctggtcccgggagcgaaggtggtcctcagcataagcgacgatccgaagaggaagaccgggtacgacctgatcgccgtctacaagggagacctgctcataaacatggattcccaggcccctaatgcagtggtgaaggaatccttcgagaagatcgtagggaagtgcgacaatgtggtcccggaatacaggtacggggactcccgcttcgacttctatgcggagcggaacggggagaaggtcttcgcagaggttaagggcgtcaccctggaatccgacggtctggcactatttccggacgccccgacggagagaggtctgaagcacatccgcgaactcacggggcttgccggcagcggttacaggtgctgggtcatcttcctgatacagatgtccggggtgagaggattctcccccaactacgccatgcagcccgaactgggcagggcctgcgaggaggccgtcgccgccggcgttaacgtggtcgcctatgactgcaccgtcgccgaggattcgttatggttgggggacgaggtccccgtcatccttcactcgtaatggtcgtaggcggcgttcttggaattctcgtcgctcatctcgttgatggtggtgaggtattccttgatggcagcctcctgctcctggatcatctgctgtacgaggtacacgttcttcatctcggccctcgcatccccgagggaacctccgtcctcctcttccttcatctgctttatgagggtcatcctcttgctcctcatcccttcctcaccgaaggctatcagcgagtcgagggcggcggtaccgtaggtggtggcgttgatgaacctcatggcggcatcgcatatctccgggttgaaatcgaagtcgatgtcctccaccatgttcatcatggccttgtggaggctcttggtctggatgcggaacgtctcgatcttggtcctgcccgcatccgttacgatgtccgacgggccgtacatgtccttcaggtcgcgtatcttgaagtcggagacgatctggaacgtcctcacctccctttccggaggggtgatcagcatgttcttcctggccagatacatgtctatggccggctggacgatcctgttgtgcctgatgatcgccctgctctcgcccctgcgcctgctctggagctggctcacgtacatgacggcgtccatggcggtcagaccgatgacgaacgccaacgagttgtccgccaggttgagaagatgggtgttcaggtcgcccccgtcgccggaaactatgaaaagaaggagctcgaagaacaggaacgcgcagaagatgatgaccgtggatacgatcatcgtgcggaacatgctcttcttctccatacgggcggcgctcttcttcctgtacctctcccttatggccgaacggtcgtcggcgttctccgccttctgcctgcggagcgtacgctcctgttccttggacgaacggcggagctgtttctcgaccgtcttctccgccctcctctcatccctgcggttcatctcactcaacaccgacgatcttccttatggctgcctgtgtctcctgcggcgttccggtcgtgttgaccatgtagacctcgcactgttcgaagagcttcttgaagaagttcgcacggagggtgctcctgaaggggtcgcggactatctgatgggggttgcacaggtcggcggacatcagatactccagggcacgatgggagtctatcttctggacgacctccttctcgaaggtgttcctctggagaaggatcacgtacctcagcgaacagccctgggacacggaggactcccccgtcacccagcggacattggctatgccccttcccttgttgtcgaacttcacgttcttgaccaggggtttatactcctcccacacgtctccgatatccgcatcgatgtagcagttcttctccgaaccggtcaccttgggcctaccgttcccgaacgtgacgaaataccagtcgtccgagatcagggaggagttgtcggccctgagaagaccccaggactgggtggtcttccccgtcttggagggggctatgagggtcactccgacgtcgtccacgtctatggccgccccgtggacggaatatgtgtcgtgggtcccctccaggatgtatccggctatgccgagggcgatgctcttcacccatccgtaatagtcgaaattgaacaggaacgctgtacatgtggcgggctcgaaatagagtttgctctccggttcctccttgtccgttatgcaatagaggcgcgcatgggcgcggaccctgtcggatgcggcgtagaagttgtccctccacatgtcgatatggtccctgtcggaggtgaaaaactgtactattatcccgttgatgtcggcctttgcggagaacagcccttcctcgtcgtatctgtcgcggaaggacttgcattcgttctccgagatgagctcggtctcatatggcataatctggctcaatccatcgcggattaaaataacattccctttttttgggatcgataccgtatgatatccatacacggcaatgggattataaacatcgatgccgcacaggggatgcgataaaaatggcaggaaagataaccgtcctgataggcagtccccgtgccaacgggaacagtgcgaagatcgcgaaggccattgccgacgaatgtcaggccatgggcaaggaggtggccaccttccacctggataagatcgagggactcagaggatgcagggcctgcaacgcctgcaagaagaggggaggatgcatcgcgaaggaccccaccctccccatactggaaagcatagcgggatcggaagggatagtgttgtccaccccgctctacttcaacgtggaatcgggacagctcaaactggtcctggacaggttctacggattcctctccgaggatttcaagacgttcctcccggggacccagaaggcggccgtggtcgtatcgtgcatgacaggggaggagagctcggaggactgcgcctcgcacctccggcaggtctgctccatgtgcgggatacagcctgtggggaccatagccgtgtgcgatccgggcgacgagaagaacaccttgacccccgagatattggagcgcgcaaaggatatagcgcataaactgtgataaggggctgcacgtaagtgcgggaagggatacagacgaccggaatcgcgataatctacgcctcctcgttcggaggacatgtcgccgagaccgccaaatacatggcgaaagaactcgacgctgacatattcgacctcaagaagcagaccaagatcaacatgacgtcctacaacagggtcataatcgggaccgggatccatgccggaaagcccttcggaaaggtcgtgtcgttcgtaaaggataacaaagccgtcctggacgacaagaagacgtcgctcttcatatgctgcatgtacatgggcgacaaaggggacgcgcagtgcgagaaggtctccaaggatctcgggatccccgacgccgcatatttccccgataaaggtgagaccgacgagaacggcgtgaagaagggcgtcgtatcgttcatccagaggatgaaggcatgagcaccaccgcgaccgcggccatagccgtatacgccctgatcaacctcatatcgttggcggcctacggctgggacaagcataaggcggtgaaggacaaatggaggaccccggagaagaccctgatccttctgggtcttgtaggtccctggggagcggtcatcgggatgaacctgttccatcacaagaccaggaagaccaagttcaaggcgaactatgtattcctcgtcctccacgtgatcgtcatctgcctgatagcgggcggatacgtccgaatcggataaaacaccttactggcacatatccgccgtcagtctgtccatgcgcggtgacggcggaagacctttctcccacgccttcctgacatccagctccataccctcatgacccaggagcacgacgcggctgtccgccttctcgcgaagaacgtccatgccgagtatgtcggctatcctcttcgagaaatcctttatggtctcgaacgccggcatcccgtccaccgtgagacgctgcctcgaaccccctacgaagacgtagcccttcggctcgatgaggtcggggtcggcgaccctgtccaatctggcatagctctccggatccatgagattgaccccttggacgagcgtgtgcctgacgaccgtcctggtctccagcgaggggaacagttccagcgtcctcatgagcctctcccatccgtcctttatcttgggccggcaggccttggcatatgtggccttgtcgggtgcggccaccgtcacgtagatctgcctcggcagggtatccaacgcctctatcctctccggcatggtcccgttggtgaccaggaaggttgtcataccgcgggaatggcactctttgaagaactccgagaggtaaggatatatggtgggctctccggcgagggagcaggccacctgtgtaggattcatcgcctcctggaacatcacggggtcgcaacgctcgtcccccttgaaaccagatataagcagcctctgatagtctatgagggcgtccagcatctccttgggttccgcccattccttgacctcgaaatccttcccctccacacgccagcagaacgggcacagatgggtgcactcgttgagggcaggggtcatctgcaggcagcggtgggtctggatcccgtagaaatcctgtttatagcatgtgcgctgatggagaaggctctgtttcatccacccgcacagcttcactgcggcatggtcgcggtagatcctatagtgctggcgtatgagagtctgcctgtattcctcatccattgctatcatctcagaaatcgaaaagacttttctgggtcttcttcggaggtgcaggcgttgtcttcgccgatgcgtcgtccgccttcatcgaccccttgtcgtccgtgacggccttctcggagggtccccggacctcgggatccggcacggtctttccgacagacgtctgggtcttggcggccggctcctctttcttctccgggactgcgaagtccaggccctgttccttcttggaagccttcttcctcggagaagtcttcttcggctccttctcctccttcgggaacgcttcctcgaaggcctgcttcacctgtttcgaatccatcttctggtcgatgaggaacccgagctcctccggctccagaccggcgtccctgaccagcatcacacggaattccggatccgacatcgccatggtgcgatagaagtcgtagcagtcgttctgtatcctggaaccggagttgtgggtgaggtatccgagcttctggcacagcgaccttctgagggaacgggaggatttggaacggctcatcttcatgaggtactgggggaaacggaacctgtcgcacgtgaccttcttggaatggagggcctccggtatgccgctggtcatcatatcgcgggcataggacatgaatccgtagttctgacgtttcattatacgtcccagatacacgtccgcacgcgacagcctctcgcagcacctcaccagatcgccggtcgaatggcactcgtacgggatgttctcctccatccagagggcgaccgtgccgggatcctcgtccacctcgttgtacgtatggaaggccagctgcgggtcctttttgcggaatacggcgtccatcagggcgtacatgtccttgcggaccaccctcccggtgagtacggaggcgtcctcggacgtcacgctcccgtatccgtacgccagagactccaggtcccttatggcggcacgcaggtccccgttggcgttctcggcgatcttggatatggccagggggtctatgtccacgccctcggccctgcagatcttcgcaaggacgttctgcacggcggatgcggtcggcttcctgaacgagatctgtacggtctccgtcttgaccgcggaactcttcctagagagttcgtagaaatcgttgacgatgaggatgaccggctgtctggcacattttatgagttcgtttatgacgggcatggcccccctgtccgcattgccgaaaagactgtcggcctcgtccaggacgaccagtttcatcccgccgtccttgacggacatgaaattgccgtcgtcgtcgaaggtgttgaaataggatgccctgagggcgacgttgcggatggcctccccggtcctctggtcggaggcgttcatctccacgataccccatcccatgtcgcgggccagggcctcggcggaggaggtctttcctatgccgggggtgcccatgaggacgagcgccctcttgggcggtgcgcccctgttccactgctccgcccactgcctcatcgtggccgcggccgagggattgccgacgatgtcgttcagcgactggggcctgtatttctcggtccagtcgtccgccattacggacccctcttgttatcgggccctttgaagtagaccaatccgatgacctccatgctctgcctgaagtatatgaagaactcgaacatcagccacaggaagaacatggaacccgtcgtcctgatgtagaagaggtacaggtagatccatatcgccgagatcgccatgtagaggaacgcacgggagtacttcttcatgaccagatgtccgagcccgaacacgctgaatatcccggggacgactgcgagaccgatggctatcttgtccctcgtggtgagcttgcgctggatcatgacctgtgcggtcatcatgggggctatcggctttccgcaggatgcgcagaatgcgtcgccctccttgttctcgaatccgcagtgaggacataccccgctcttctcgttgacgggtacgcccgtatcgtcgatcgccatcgcggtcttcttcagcgccccgcagctgtaacagaattccgcatcgtccgggatctcctgtccgcattcgcggcaaatgtacttcatcggctcagtcctcctcactcgagatacatacgatatatccctttggtgctttcaacctttacatcggccccatagagtcccgagaccttgtcgtcgttcaagaggtcctccttgcggccgtcgtcgtatatcttcccgtccttgatcatcacgaccctgtccacgctcagaggtatgtcggaaaggtcgtgggtgatcattatgatgcgtactccgctgtcgatgaggatgtcgaacatcctcctgaacttggacttcatcacgatgtccagcccggtcatcggctcatcgagtatcagcatcctcgggttcgtgaccaaggccctggctatcagggccctcctcatctgacccagggaaagtccttcgatcctcctctgaagaaggtcgtcaatccccatctcggcggcacggtatcttatgaggtcctccatctcttcggtgacggtcatgccgcggaagacgtcgagacttccgaagaacccggaccctatcacttcgcggacggtcgtcattccgccgaacctgtcctgcagatccatcgatacgacccccatcttggtgcggaggtcgaagatgttccaatggcgctccccgaatatcctcatggaataaggctcatcgtcatcgtacggatatacgtcccccctcaggagcttgaggagggtggtcttaccggaaccgttcagacctattatcgccacgttctcgtcctggcctatggtcagatttatcctgtccagtatcctgactccgtcacgaacgaccgaaacattggatagctcgagagcgttttccatgtttttccgtaaagaggtcttgcctataaggttatccttttatagaagtagaatacggggaacggcacccgcagatgtatgagaatgcaggggcccgaaggcccccgggaaaggttttcactcggcctcggccggctgcatcttcctcgatccgcaatacctgtcgatcgccatgacgatcaggaatgcggctatggagagcggcaacgagacgataagggcgtcgcagtactggatgggaccgctgaaaaggaccgcgtccccggtcagcatcttgcatatcggaaggaacacggagctgctcttgttaatgaacaacgcccagaaaaggtaggacgaggtccccactgcaatactgcatacggccgccctcttgttgggcctgcccttggtgtacagaccgtggacgaaggcgggcagaagggcggcggcggtcatccccatgaaaagggacgtcgccttggctatgatgtccttgggcatgacgtagcagtatatgaccacgaggaccatcatcacggcggtgcagatcctgttgacacggacgttctgcgaatcggcctccttcttctccctgcggttcttggcgagggtgtacaggtcgtaacctccggccgcacctatcgtgtgcatgagggcgctgatggtggagatggaggcgcagaccagcgagagaaggaacaggcagacgaagaagtcgcctcccaggaccccgtcgaacacctcgaggatgtactgcgggatgatgaagtcggtcccgagaccgagcccggagacgtagttgaacgccagaccgccgtgattgttcatgaagaacacgttgctgagggcacctgcggtgtaggcggtaccgacgatgacgagcatgaagatgctgccaacgatgagggacctgtcgagcatcctgtcgtccttggcggacatgaacctgactatgagctggggctgggtgaggacaccgagacccactcccatcaggaatgtggtgaccacgagcatccactcgctggaaccgaagtccgcgacggaggtccagccggtgaaaccgtcgaggactcctccagccatgcccggatcgagggccgagagggactcgaaggcgttcgtcacgccgccgagggtggagaacgtgactatgaggatgacgaccattccgatgaacatgatccccgcctgcagggcatcgttgtacatgacggcgatgatacctccgtagacgacatagatgccgacgatgatggccatgactatcaggatgacgtcgtagaggtcggtaagaccggtgatgacggccaccgagttgactcctcccttgaggacggcggcgcagtagatgggcatcatcacgatgatgaggatggcggtgaaggcgcggatccctttggattcgtacatcttcccgaggaggtcggcgaaggtcgaggcgccgagcctcttccccacccttctcgtcttgggaccgaatacgaggaacgccacgaagagtcccacgaaaaggttgaggaaacagagccacatcagcgtgagtccgtgcgtggcggcctgtcctccgaaacctatgacggcggaggcgctgaggaaggtggcaccataggacagacctatgattatggggttcgtcttattcctccccaaaaggaactcgctgttgtccttggtgttcctgtatccgtaataccctaggaagatagtgactgcggcgaagatcacgagcatcgccgcgaatatcggcatggatactccgctcattcgtcatcacctttgttcgattttcttacttttattccgacgatgcaacaaaggaccacggttacgaaacatccgatgtaggcaccaacgatccatggatcggtaagaccgaagaagctcattttactcacatttgtaaagtgctaacacgtagcacggaggattgtccatcccgctgcttatatttaaccattgatggtgcagaccggcaacgggacgtggatccggaacggaatggccctcaaacagccgggaccgcctccgtcttccttgcatgtcctgcgaaacaggcctcagagggcaggaagcacgggacatccccgggaaccgtcccggaaaggatggcggccctgtccgcatcgggtatctggacggcggatgccccgagggataccgccagcgagacctggttgaaggtatgcacctggaaaacacaggatatgccgacgaaacgggccagtttggagaagaatacggccctctccctgtcgaccagggatacgtcgatgacgaccgccttctcgcccccggccttggcggcgtagaccatgtactcgtcgatgacgggctccgcacagacgtatccgtccacgcctgcggcttccttgctcatcatcctgcatttctgcttgagtacgctgagggggaggactttcctctccgcctcgatcttcgccatgtctgccatgtccatcattccttgttccatgctaacacttagcacgctaaacacaccaactgcgaacccgtatataaaccatgctattcattgacacggtatccccgaccgatatgcctattatgatacaggactttcgggagagcatgagaaaagacctcggtgccaagaccatactctaccccatgcccgtactgatactcgccgcctacagggaggacggcagggtcgacgccatgaacgccgcctggggcgggatcgccgacaccaaccaggtgtgcatatgtctgtcctcggaccatgctaccacgaagagcatcgccgcaaggaaggccctgacggtatcggtggccgatgccgcccatacggtcgaagcggattatctgggggtttgctccgggaacgacgtccccgacaagttcgaaaagtccggactccatgcggtcagaagcgaaaacgtggatgcgcctgtcatccaggagtttcccctgaccctcgaatgcagggtctcttcgatagatgacatctccgagggcaccgtcagggtcgtggccgacatagtgaacgtctccgcagacgaagggatcctcacggacggaaaggtggacatctccaaactggaccccataacctacgacaccgtgtcgcacgggtatttcaggatcggagagagggtcggcaacgccttctccgacggaaagagactgatgtgagatgaagagacccatattcgggaaactgtaccagttctcccaataaatcccccggatggacttcacgatccaccaatacctgttggccaccgaaccgtcgatcctgttcgccaccggcacggtccagcaggcggaacgctcccttccggagatcgaggagatactggggggaagacccttggactacatcttcgtctcccatatggagtcggactaatacggaggcatccgcattttcctggagagatatcccgatgcgaaggtcatatgctcgggactggcctccagggaactgcccgggttgggggtggagtgcgactgcgtggccgctgacggggacacggtcatcgaggagggggacatctccctgaagaccatcacatacccctgcgaggtgcatcttcaagacggcataatcgcctatgaacagaactccggcatactgtacagctccgaccttatgcaaagccccggagatggcagggatacggtcgaggaatgcggataccttcccagagcggagagcatctcccccgtacgcataccgaacgagaagggactggaagataccaaacggaagctcgcatccatatccccgaggttcgtggcggtgggccatgggttctgtttcgtcaacgcagacattatgtgaacaactagacgatgttttatgagcaatgaatacttcggcatgccgttatgactcagtccatctacggcgacctgtatcagttctcggagatgagcggcaggatgaacatgcccgtccaccagtatcttctggcgaccgaaccggcgatcatgttctccaccggcacatcctcccaggcggaatggatactgccgcagatcgagaccatactcggcggaagaccgctgaaatacctgttcatatcccatatggaatccgacgaatgcggaggatacaggatattccagaagaaatatcccaagatcgtcataataacatcccctttctccgccagggagctcgcgggattcggttataagggccgtatcatcgtcggtaacgaagggaaacccctgatcgacggacagctgtccctcagtttcttcgattatccgtcggaagtccatcttcaaaacgggatcctcgtcatggacagaggaagcggcgtattctacagttccgacctgttcgcccgcgatacgtcggatggaagggtaaaggatggaagatggaccgacgtccttcagaacatcgacaccgtactcatccccgatgaaaagaaacgcctgtcgctcatgaaggacttggaacatgcggaccccagattcgtggcctcgggtcacggcgtgtgtgtgagatgctcctcggaaacgtaccgataaacggtatatagaccacatagatgtgggtgaaatccgtccaatccattgtcaataattaaatacgcaccctacattagggcggatgttaggcttgaccggggagcttggcgtgccctgtacctgcaatcgtcacagcaggggcgactgagaggggcggcgaagcggaagcggtaggcccacaaagcgactatgagactttgtcctacagagtcggagtacccaattggactgaccggagggccggttcggttgggctaatcggggagaacgggtcaggccctgacgggagcagcctcactccgaactactgacgtttgcggggaagcagagttgaggaacgatgtggctaacctatctgtggatgcgacgtccaccttcttgagcctaacacttctgttctcagaacgttcgatgtctgcgagccttgggtctgcacccggttattatatccttgctgaaatcgaagaggacccccttctccccgtccatggagagtttgagctggagggaatcgtccaccttacccaccaccgctcctgcgcatcccactttcgagaagatgtcgatcacgcgctgggagttctcgggaggacacgcatatacgaacccgcatccctgataggcgaggagccaatgtatgaaatcgtctttctcggacgaaggcacggggatcttgtccagatcgaccgtcgcgcccatgcacgatgattcgagcatcatcccgagggtgccgacgcatccggggttgctcatgtcctttccggagtggaccagatgctcctcggcgacgacggccgcggcctccatctgcctctggaccagtttggggtccttgtcgagggtcgttacccacgcataggggatgttcttcggataatgaccatccagatccatcaccatgactatgtcgtcacccggttccgcggtgctgctgaggatgatgtcccctttcttcaccgtcccgattatcgatatgtcgatggcgtggtacttgcagtccggatgggtgtgtcctccgactatcggtaccttgaaccttctgaccccttcctccataccccttagcatcctgccgcagaggatctcgtcggacatgctcatgacgtccaccatggcggtcgccctgccgcccatggcggctatatcgttaacattcacgaggactgcgaaatatccggccatgtaagggtcggactccacaagggactccattatgccgtcggccgcgaaaaggatgtagttctctccgtcctcgatggcggccgcatcctctccctcggctgccgctacatgcttgaaactgtctgtcgggagaaggtctacgacctcgtggatcttgcctttccgtgttactcccggaaaggaccttatagcatcgatgacggcttgaagggccatgtccactgcgattgctctccccgatataagagtttactacgtaacatcagaacagcttggtctgcttggtggtcaggaccagatgttttgcgtccgtgcagtccagaacgatgtctgcaagtatctccccgaattcctccggatagtccttcgaaggtatgtatgcgttgtccgaaggtactatgttcccctccttgcgcagaagtttcttcgtatcgctcacggcctcctcgtccgcacgggtcccgacgggcctcatgactccggagttcctgagttcggattcgaatatggggcgtttgaacaacttgtatagtgaatagaggatgacctcgtccgtatcgacgccggaaagtgtgcggcaacgtttcgacaccgattcatacacggaatccggcagccttttggcagggacatagatcttggccggagggacatccctcatcttgagatatccgaggtcggtcatggcacgcagatatccggtaaggaccaggcggtgatccttgatacccatcttggcaagctccttgtcgagagagcttatggacatcccgtccttgcccaaggtctccacgatcttcctgcttaggtccttctcgggactgaacatgtttccaacaatgctctggccggatataaggctatatgatggtgtttaaatttcattacatttagatttattttttacaaaaatataatattgaacatctggcctattgaattgataaataatatggtaacaaatatgataaaaataaagaggtcatattttaccaattccagttcaaatttatttaaatatttactacagcgtggttcattctgccagtcattcggtgtgcggatgggaatgcacaccggagacctgtcccgtgcccagaatcccagttctgacacatccatcctatctcatacccttggacaggtttccggtcaccttccccatcccacacttcatgattttgaaatgactggatttccattcaacgccgtcagaggatggctacgatgattatcaggacgtaaaggaacagcatgagggtcgaaacgttcccggcgatctcattggccttcttcgccctggcctcctcgtccttctggcccatcttttccaagaccctgtccacccatccgaggaatacatatcctccgtcgaaggggaaggccggaagggcgttggagatccctagcaggatgtttatccagaagatccaatacaggagggtgacggccatccagaagagaccggactggtcgccgtaccaccactggacgctctcggggacgggatcgaacccggagaacggatgtgccaagtatcccaggaggccctggccggccgtcaggatatccttggatccgtagaacgggttggaggcgtaatcgagaaggtccttcggcgttatcaggttcataccggagaggtccgtatagacccccagatacccgatcgaaccgttggatccgagcaccaaggtcgttgtgacatacgacccgtagggatcgatgtaatcgacgctcaccgtctgttcgccacgggtggtggacatgaaattggaaaaggccccggacgtgtagaacttgttcccgtcgatggatacgatataactgccggatattatcccggaggtctcggccgcctccccgtcgacggtcttcgagacatataccccccaacgcatcggcgacgagtgatgcgattcaccgccctcggtgacgtatgtcaccgtcaccagagaaccggggtcccacgagtatgtgacgtcataggagtccgaatacacgaactcctccccgtcgacctccaggattatggcgcctgcagggatccctgcaaggtcggcgggagacccttctctctccccgtagacggccgcattgtcctcgtaaggcgacgatatgcctcccagaaggaccgtggagaaaaggaggaatgccacggcacctataacgaagttggtggctatgccggcggcatacaggtcgagtctcgccttcctcgaggccttctcgacatcctcttcctcgggctcgacgaacgcccccaacggaacgacggcatacaggaggcccgtgttctttacacggagaccgttggcacgtgcctgtacgccatgggcgaactcatgacaaaccaaggcgatgatcaaggccgccagaccataccagaagggaagtatcggattgaggcccggtatcgcaagggcatactctatgcctatacctcccctgctgagggtgctgggcaggtttattacggccacgatgacgacgtagatgatcagtaccatcaggaggaatgccaagatctgcgacagcacccccatgaagcgccagaaacgacggtacttgcatacgcgatccatcgtctttatcccgagatgggtgttgatcttgatggcgggaccgtacttctccatcctatacttcttcgcattgggacttttccatgcgaaataccacaccggaacatagatgatggcaaggatgatgaggatccacagcgtcagactcattctatctgtcctccgtagaccgtcctcataaaaggatttattcgtctgcggccgcagcgattgcggacagggtcggcttatatggttgcagtttccccggcgacgtcctttattatgcgacgggcccacgagagcttacgccgctttacctcggggtcgctcccctctttgggatacgggtcatcgaaatcgaatcccagcagccttatcctgacggcaccgaactccttcgccagacatacggcgcggtccccgtcggtgaatccgccgtagttctgcagtatgccgaacggcctcccctgcgtagtgggtaccagcggacctctcatcagggggatgtacttccccacgagttccgcattatccccgtgtgcgaggaccagcgtcaggaccccggagttgcatgcgtctatctgaggacctatgtccccgtcgaggtccgtgacgacgatatcggggcgtacccctgctgccatggcccttcccacggcggatccggccactatgacggtcccctcgacacccttggataggatgtccccctccagaccggaagaggcccccaggacggtgaccgtatctttgatgagaggagctatggaatcctcgtcccggacgtccgagttctgcgtcagggcgaggagcatcctcgcggacatgtcgtcgcacgacgggtcgtaacccatgtccgagcatatcgagacgtataccggttcccactcagagaacttcatccttcgtcccctctttctcctcgatacccatggcctccttgacaatatgctggaggacgagcgccgcgatgaagaggacgaaacctccgatgatctcgaagaggacgatcgtcatgctggcagatcccaggtcgaggttggatccgacgaagtcgaacgccccggtgagcagcataccgatggccacgatatccagacaatgggtgatgaaacgatatttgatcacatgggagttcatgtagcggtccagaagcgtacctcccatgatgaggattatgccgaaaagaacaggccacagggcgttgcatacgaagaggaccaaccgctgaagggtacgcgtcgtgtaatagtcggtcagggagatgaaaccgatgacgaccccgatggccataagtgccagacctccgatgctgaagatgacggtgacgctccctctcttggccctctcggcccatttgtccttggccctgcggagacgttcgtccacactgtaggagtacagtgccagcatgacacctatgaagaatactatgaacagggtggtggacgatatgaagaaatcgctcagatcgtctgctattatcaatccggccgcgatgtatatgctggatatgagcatgaggatccagctcacgggggccaggaaacgttccctcttctgaggatcggacagggtcttctggatgatatagaacgtaccctccacgccgggggcctgctttacatagaccttcctgaccgagtcgatggacacacgcgacgatattatcggatacacgtactcgtcctcggccccgtcaccgacgaggatggccctgttgggattcaccttgtccaagacctcgttgagttcgtctacgatcttcccgtccgacttgtatcctaccttctggtccccgcatatcagcgcgacctcgaaggaaccggcgggctcgccgtccttctccatctccctgtagatgttcatcgccgcatacagggcgttggtatcggaatcctcgggatcggccacaccaagagccgtagctgcctcggcacaggcgtctatgcctatcaccggggtcttcacgctgcccttggcaccgaaatcgtcatccctgtcgacgacgaggatcagggtcttcttcatcgtacgggctatcggctttctttataattattgttcgttcggaagatgcatcctgctgtcgatacagttattacgacgtccgataatcaacccctgtgttcataagatggcacggctactcgtgtttcgagttcgccgacgacagggtaaggatggtgatggatccccacgacgggaagtcgataggcatttggcctccgaccgtggccgccaatctcgtcctgtgcacccacaacaactacgaccgcaacgcattcagggtgatatacggccaccacaaggactacaccgaggccatcggcgagatcgatttcaacggattcaagattacaggtctgccgtcgttcagcgacgacaagatgggtgcggaaagaggcgtcaacgcgatatacatgttcgagatggacggcctcaggatagccttctgcggagggctgggcgacataccctccgacaaggtcatcgacaggatgagggggacagacatcatgttcgtacccataggcgagtacggcaccatgcccctcgagaaggtcgacggattcgtcagcaaggtggaaccgaaggtcgtggtccccacggattaccgcgtaggaggcatcacgctccccctgtccacactgtcccagtacatggaagggaaggacgaggaggacttcgtccacgtcggcaacgaggtggaactcatggaggacgacatctccgagttcaccgggtactggatattcgaccggtgaccagccgtctggaacaggaccttccgcttacaagacatcctccggaacggtcattccccccttattttcgtggatctccatcctgtcggaagaccccatcccgaatgccaagagtccgagtatcagacacatcgccgcagcggccaccactatccagaggagaccgtcgttaaatgccgtgagggccgtatccactccggacagtatgacgttcaacaggatgtccacgacctccgtgacgtccccttcgaaatctatgctcatctcggctagacggacctccacgtaatttatcagatagtggtaaacgatggaattccccgccactatacccagcatacgcagggacatcgtagtggatgtcatggaacccatgacgctcctgtcggacgtcccctgtatggagcatatcagttcggtaacgatgcacccgagaccgaccccgaacaggaagaggcagaccccatgcagaggatgctttcatcggctatgaagtgagtgagtactggtgcggcggccacgatgaccgcaccgcaggcaacccatggcctggcacccgtcctgtggaccatcctgcatcccggaagggaggtacaagcccctcccgccagcaggaacaggaacatcagactggcattgtagatgttgaattcgaaatgcagcagataaaacttgaagaaatactgaacgagacccagaccgcatgcgctgaaggcgaacatgaggaacaccatcttcgcctgcatccgggacatatgtatggggaatgccggatcggccgcgtgtctgcttctgacatatagcgccacacacaggacgatcatcgcggcgatcgaggcatacgacgtcgctccgaacatatcgaaatcatgatcgacgatctgggtatatccgagggccgatgccaggagtgccgtcatgagcaccatttccgggacgtcatagctcttgttcctgtcgacgacctcgtccggcatggtcctgtaggctatcacgaaacctacggacatcaaggctcatcaagagccttaaacctcttaaaatatcttctttttcttcaaatatcttgaaaatgttatgcatttgtttcagtcatttataaataaagttgaatatcgtttagtcccgaattagacctataaagattttttaggcccattaggcccaaattagacccaaaaaacgggttgcaatttccgttaattgctgacaacaaatgacgtaatagtggctgtatcctttgattgtctacatcgttacgacctttcacctaagttaaagtacagtgtgcacattacacctttgataacttgttcttgacttacatggacgaatccggtaaaccgaattacaacgatactgagaacgaatatgttctcgctgcaatcacaatccatgaatcagaatacaaacacgttgagaatgagttgtcaaaggtcaaacaatccttttttccagacaaggatccgaaagatatagagatccatgcaaccgatatcatcagccgtaaagggattttcagcgaaatggacgtatcaaaacgtcttcagctgctaaaggatatcctgagcaccttgaagatgattgattgtactgtgaactgtgttctgattaggaaggaaccattgaaaggtaggattgcagatgtggataatgtcgcttacaagttcttatttgaaagactctgtttgacgcatcagaaattgaataagatattggttaaaggcggatcggatcctcaattcggcattctttttatggattcgatacaacccaaatttgatgagaagatcaagatcggggtacgtaacatgattgccgaggggacagagcacatcgtcaacgactatatcatcgaggatgttgtcttcgtcgattcaaggtacagggcgatgtctcagatcgtcgattgtatcgcatatgtcatcagacgttatcatcgtctgtcttattcaggttctgtcaatgaatcagaaatgtctttctacaaggaatgtttcgacataatacgtccacgcatcagaaaggggccgaatgggcgcatgaaaggcgctggattgaaaatatatccgtaaaacatgaattggcagagttaggtcgcttaggagccacatccctctgccgggtcccctgcttgggacagttacatattgtcggagcgatatttattctattcgttctaaaaagaacaaacagggattcatgtcgctcaggccccaacatttaaccgtttttaggttcctcgacgaatcgtgtgggtaaccacattcacacaggtgtagtcggcgctccgcgcgactacaccctgtgagaactcgaaaacaaggtcgacgattcactcggaggcctgcgggaccccactcgttcatcgtctcattaaggcctcggctacgccatcggcctgtgaaggacagccaccatgtcattcttagaagagtgatcaacacaatcctgaaccacggagatagcacatggtgcggagatttctccaatccctgtaccctcttgcacgcctcttcacagcctggatgacgctgttcatcccttccatcacaccgttgttcatcttggaacggaaccaattgaggatctcggagaagtgattgtccaccaccttgatgatgtccctcaatgcggagataccggtacgttcagccgttatcagccaatccaacagatgattggccgcaccatacccactgtcataatcccaagtgtccctcagggattccttcaatccgtatacgataccgatttccttatgggattccagaatccaatcgaccctttccttctgggaaggtgacagattctccacgttccttaacagaacgaacctctgtcccttgagtttggtggcatccttcaatctgcccccctccctcagaacgttccattcgtgtcttctcgctctatccactgccaaactcatgtgctgtatcacatgatatctgtcgtatgtcaccactgcaccagggaattcgttctttatccctgataggaatccctttcccatatcacaacagatgaacttcacgttggatgccttgccctcatgtgcttccagatgttccctgaatcttgccacagatgatgcatcgttgccgttggtgacgaatatgatgttatgatcctcgtccacgaagatgctcacatacctgtgacctctcctacatgatgtctcatccacatagaatctgtccaattccgacagatcctgatgcttcatcctctcttcgacatgcttatccaacaccctccagagacgtttgtccgtgactccaagataccttccggtggcattgacgggcatctccttcatcagttccacacccttggcctcgaacaacaaggtgaaaccgctgttctcctgtgcccatggaacatcgacaagcatgaccttcccgcatttcggacactccatacgtggaaccgcacaatggagatgacattccatgtcgaagaaatccatgtgctgccaggtcctttcgcgtttgtcatagccttcgcatgagcatccgcaatcgggacaaatatgttccaccttccctttggaacggatacggatatcgaccctggtctcggtgtcatcgatgttcatcgagaacgccttccatggatccgataggtgcagggccttgtgaacagcttctccgcactcttgctcagcgaaatacatcgcattcccgtgaaataaagggttctcatacctcttcgacagaacctacatcagaaaaactgctggcccacacaaagtgtcgaagaggcatatttaaaaaatagaccgtaaggtcacggttaaatcgttttttgagtcttcaaagggacagaccgtcctcgatccttcccatctcgatgggcgtggtctcgtctccgacaagagcccccttcgaattggcgaggatgccggcaccgatgtacttggaaccgtggttgacggtactcctctgcacatccaccttgaggacctccctcaggatctcgacctcgtcgtcggttgcatctgtgctgcatacacagcccttgttggtgcacctgcagacggatccgaccgtattgcatccggccacggacgccttgacgacctcgacgttcagtatctccgccaccttttccgcggtcctgtcgtccatctcgggattgacgacggcaccgttgtcgttgacgaggatgttgttacctgctgcattgtactggtccggaaggagcagtaccggcaggcacttcctgatgacctccacctcggattcctcggccaatcccgagagcaccgccccgttggagttcatcgcgacgagggaacccaccacgtgggaccccgaaacggttgtttggaagggtttgacccccagcacctcctccacgtccttgatgaacgcggcgtcggcgtcgggggtaatgaacgcgaggctctcgttggcgactgcattgacgcctatgttgaacgtcccagctacccttgtgagcctcatcgacatcttgatcactcggaaagagagacctctacgaggccgtcgtcgaacttgaccgctttcacggtgatcttggaagggggattgcggattccgttctcccacagcttctcgttgacagtcttgtcgatccagacgtgctcggcatccaccttcatgtgcctcatgatggcggccctgacctctttcacggcgcgctcggtccttctggacctgggagcaagccttgctcccctgagcggaatgaccatgatcctgctgacttcgtctgccatttgaatcactccttaagttttcccatgcgccacgatcttctcttcgggtgcctgaggaactgcctgttggtcctgagcatgacccaggcgggaacacggcggttctgcttgactttcttgttgagcctctctttcattgccgggggctttgtactagacatgattatctcctctctatgtggatctccctttcctgggggaccatactctgaaggatctctctcagcatggcgtcggtgatctgctgctgcagccttccgccctgataaagacggatcatctggttctctacggatgcagcgaggttggggtttgcaagcttcacgttcgcgagcctgtccctggcctccggggtcatgatctgcctgaggatggattgtttctgggcctcgatctgtttagcctgctcctgctgggccgcctgattctgctggctctgctggagctccgccatccttctctgccttatcgcttccaattcaggatcgtcgtccatgccaattaccttcagttcttagattcgtcaaatacctctttggcagagttgtcgaggagcttctgtccggcgggggagatcttccttccctgcttgtcctgggttgcctcgaggaggcctgcgtcctgaagctgaatgagacacttcctgacgatgttgcggcttcccttgactgccttgttgggcttgcatcccctgtcgttgaatccgccatactcgcctgcgagcttggaggttcccatggggcccttcacatacagcttcctcatgatggaggctgccctagtgtaccaccagtcctgctggacaggtgccctctcggtgtggattccggtctttgcgaactcggcccactcgggaggaacgatcttatcgttctctttgagcttctcagacactttgagaatgagtttctcagcgggaacgtcgtagactgttaccatttgttcatccttctgccgcaaggatggaatcctacgcggctgcaaggccggataggaacaactagtatataagcatagctaaaatcaattactatgccaaattccccgtacgtccggcttgcgcccccgtacggcctgagggagaaattccctccacggcggatacctttcggaatccaaaatccgtgactctccccaagactacgacatatttaaacaatacggaggtccgtcatggatcggccttcttagcggccttcctgcgtttcttttccttcgcatcccatttcccgactatctccttcgcatccctgtttccgaaatcggcggccatgcgggtatagaacttgtacttctccctgtcctcggaggtgcctttcccgtcacggtacatgcacgccaccgcatacatcgcatactggtcgccattatccgcagcctgcttgaacagacggaaagacagaccggggtcgcattggccggtcctcccgtcgtcggccgccttggcaggtacggcccttcccctggcaggacccttggccaccgcggcatacagcgaagaggctgcggagagatccttcctgactcccttcccggagaccatcatgtccgccaggttcccggccgccctcagattcccgcagtccgcggcatccctgatcatgacggccgtctccggccttccagcccctccgcgtctgcgaatcgcctccagggcgtacatacgcgcctcgttcaattcggattcggcattcctgcggaaccagacatccgcctcgacggcgatttccaaagagggtcccgcatcgcaggatattctgattcatatatccagagcggaaacttcaggaactccggagggaactataccttggccgcatactgctcctgcggtgcatgtatcgtcatcgaggatatgggcggacacacctacgcattcaatcagaagacggagcaatccacgcaggaactttacgacaccttggtcgaaaagacaggattttgacacggtccgaagcgacggaaccaccaatgcggcgggacgacacggcgtacatgggatacaggtacacgcagaacaagaacgtcagcaacagcacgaccaccaacatcaccatacaggacacctccgtgcagaaacagacggcgtcggagatctatggcatactcgggggaggtgccctctaaaaaccattaaatcccgacattcccataacatgaccatggccggaatgagccccgagcaatgggacaagctggtaaaggacctcgagttcaaccataaggtcgatatgtggctgacgcggttcatggtggccggctgtatcgccgtcttgatctacttcggcgtatagtgctacatcgcccccatgttctgatgcgcccatggtccgtcgaagggatgccggattctatacatcgagagaaggcgatacaacggcatccataacggtcaggatcctggagaacgacgggaccacatacacgcagaccggggcaagactctgaatctccgacggtcggcctaacatatccccgccacggggacatccgcaccccacacctccgttgtatcaaaattataatattacggatagtatcggtcagaccatgacagacggtaccgggctcaagaacaggggccacactcatgcggacgtcgacgagaggcgcgaggctgtcgagcagtactccggagcttccctcgagaggatagccaaatattgcttcaaggcggaggatgccgagcacaacatcgagaacatgataggtgcgacacaggtccccctggggttcgcaggtcccgtcaggatatcgggagaatacgccaacggcgatttcatagtccccctggccaccacggagggggcccttgtagcctccatctccagagggatgtccgtcatcaacgactcgggcggggcgaggaccaaggtcttcggcgactacatgacccgcgcccccgtcctgagggtcagggatctggaacatgcctgccaggtcatagagtggatagacgcccacgaggacgagatcaaggccgccgtgtccggtaccacctcccacggaagactcgcaaggatcgagaagttccccacgggcaggaacctctatctcagattcagtttcgagacgggggacgccatgggcatgaacatggcgaccatcgcttcagaggccgcatgcaaggtgatcgaggaggctaccgacgccgtcatggtgtccgtgtcgggcaacatgtgcagcgacaagaaaccggccgccatcaacatgatagagggaagggggaagaccgtcgtcgcagaggccctcatccccagggagactgtcgagaagagactccacacctccgcggaactcgtggtggagacgaacatcaggaagaatttcatcggatcctccatggccggcacgctgggggccaacgcccatgccgccaacatggtggccgcattctacatcgccaccggacaggatccggcacaggtcgtcggagggagcatgacccttacggactgcgaggatgtggacggagacctgtacataagcgtgaggatgcccgccgttgagctcggcaccgtcgggggagggacgtccctgccctgtcaggcggaggccctcagcatcatgggctgcaagggatcgggaaaggcccgcaaacttgcggagatcctggccgccaccgtcctcgcaggggaactgtccaccctggccgcacaggcggcgggacagttgggcaaagcacatgcagagctcgggaggggaaagaaatgaccaacgtcaacttcagctacaaggatctggaaaaactcatggggaaggagctcccgcaggacgaggccctggagaaactccaactgatcggctccgataccggggacaccgtccccgggtccgacgagatgaccgtggagttcttccccaaccgcccagacatgtacagcgtcgaagggatagcccgcgccatgcgtgcatttctgggcatcgaaccgggattgaaagaatatgccgtggaagactccgatatcgaagccgtggtcacccccggcgtgaaggagatacgtccctacttcatgtgtgcggccgtcttcggcgtggatgtggacgataccgcactccgctccatgatggagatgcaggagaaactgcacataaccgtcggaaggaagaggtccaaactggccatcggcatacacgacctcgacaaggtcacccctccgttcaccttcgaggcggtggacccggacaggttctcgttcgtccccttggcgaagacggagaagatgaccatgagggagatcctcgagaagcatgagaaaggaagggcgtacgcccacctcatggacgggatggagaaattccccgtcatcctggatgccaagggcaacgtcctctcgttcccgccgatcatcaacggtgctctgaccaccgtcaccacctccaccaggaacctcttcgtcgacgtcaccggtttcgacgagggggccgtggaggagtgcgtcaacatcgtcaccaccgccctcgccgagcgcggagggaccataaagagggtccatatggagggtgcccccaaggagagctatcccaacctcgagccccgcaccatgaccgtatccctcaaggaatgcggcagattcgtcggagtggatttcacccccgagcaggccgtggaagccctcggaaggatgggactcggggccgaatgcgacggcgacagactgaccgtgaggatccccgcctacaggatggacttcctgcatgacgccgacgtctacgaggatgtggccatcggatacggattcgacaactacggaaagaaaaggcacgatgtgacccagacgttcggaaagctcctgcccgagacctccttctccgagaaggtcaaggatataatgatagggcttggatacaccgagctcaccaccctcaccctcagcaacaaaagggacgagttcgaaatatcgggtcttcccgaggtggatgcggtcaccgtcaaaaaccccatcaccgaagaacatacctgtctccgctcgtacctcatgccgagcctgatgaagatcctcagacacaacaagcaccgcgacctcccgcagaagatattcgaggtcggtttcgtcataagggatgccaagaccgtcctgcatctgtgcgccctccaggcggcatccaggagttccttcaccgaagtgaagtccctgacagagagcgtcctcagggagatgaacgtggaatacgcgttcgagacctgcgactactcgactttcattcccggaaggggagcgttcataaccgtcgacggacagcgcatcggcgtattcggggagatgtccccccggaccataaccgactacgagatgacccatcccgtgaccatgctcgagatggacctcaccgggatcatatccaagagatcggggaggctgttctgatgcaggcaggcgacatgttcccgcatttcgtccttcaggacgagaacggggagaaggtggactccgacgccctccgcggcgtacgctatgtgatatacttctattcgaaggacaacacgcccgggtgcaccaaagaagcggtcgaattcaccggcctctaccccaagttcatgctcaggaacgtccccatattcggagtcagcggggattcccccgagacccacaggaaattcagggagagtcagggtctgaaggtcaagctgctaagcgaccccgaccacgccctagccaaggaggtcggtgccttcggtaccaagaaactctatgggaaggaggtcgtcggcaacatccgttccaccttcatcgtaggcagggacggtgtcgtggaggaggcatggaccaatgtaaaggccggagggcatgcccagaaggtcctggatgccatgctgtcccatttcagggacgacgaacccatggaattctgatcagagaatcctgtccaattccctgaggaccgcattggcgtcgccgactattatctcgtcggcgacctccccgatcctcgcatcgggatcggtgttcaccgagatcactcttttggccgaggagatgccggccagatgctggacggaaccagatatcccgaatgccagatacacatccggggctacgctctttccggattgccccacctgacgggactgggggaaccaccccttctccaccagtttcctcgagcatgagaccatgcccccgagtttgcgtgcgacggattccgctatcgggatgctgtccttcttcacacctgcccccagggatacgagtatcctggaccgcgttatatcgtcctcttcgttcctcacattttcggaggatactatgtccttgagcccgcacccgtcgtactgccaatagatcaccgtacctttggcaccctcggacggatccgatatcgggaatacgcccggacggaccgtagccatctgagggaatgccgtacattggatggtggcgaggacgttccccccgaaggcggggcgggtcatggagattatcctgtcgtccacggaaagatccgtgcagtcggcggtaagccccgcatccagcttggccgcgaccctcggggccaactccctccctctgggagtggcacccatgaggacgaccgcgggctccgtcctcacgattatctgtgccagagcatcggcgtacgcctcggggtggaaggtacacagcctcttgtcgtggacctcgtagagcgtctcgaccccatgagagaatatctcaccgtacagcggcttgagctccgcatggccgaatacgaccccccatatacgggaaccgtcgttcatggaacggaccttggacaggatctccaggctcacatccgataccctgggatattctccggaacggtcgatctcgacccagatcagatacccgtcggaacggtccacgttcagtttgtactgttccagcatccccgggggaagtcccttgttctttccgtcggacgaacagctgccgcccgaacacgattcgcatcccgtcacagcaccccctttatgaattcggcggccgcacgcgggtccgtcccgtccgtgaccctgccggaacgttccagacgtacggcgcgggactcgactatctttgtacgcgaccccctcagacctacggagaaggtaccaagacccagatcgatccttccgagcttctttatctcgtacgaggagacatctatgaacctctgtatggatggcaggggcctgttcacatcgccctcctggacggagaccaccgacccttcgggggcacggcatgtgcggacctcgtcaccgtagtcctgcgttatcaggaaggccccgccttccctttcgatgtgtgtggcatagcagaactgttccctgccgagcatgtcggcaagttccgccggcacctgggctgtatccccgtcggaagcctgcttcccgcacaggatcagcgacgcatctggcacatacttctccatgaacgccttgagcgtcctgcacgtcgcatgaacgtcggcaccggcgaacgccctgtcgctgagcagatatgcctcgtcggcaccgatctccagacagcggaacagggccgactccgcctggtccggacccatggataccgctatgaccgaatcgccgtcctccctgagggctacggccctctccatggcatattccgaatacgggtccaataccgacgggacaccggccctgacgaggcttccgttctcatccacatctataagtgtggtatctggcacttgtttcacggcgaccgcgaacttcatcttaccaccatgttacccgggttgaggatccatccgggatccatcctcttcttcactgcgcggatctcgtccacccccttgtccccgtacatcatacggacgtaatccaccttcatctttcctatgccgtgctccgcactgggggatccccccagatcgatggccttctgtgccagctcggcataggccttcttggcctttgcgaaatcctccatatccttcaggattatctccacatggggatgcccgttcccgatatggccgaatatcacatattccaggccgtagcgggtgatgacctcgtcgtaggccgacatcatctcgtcgagatgtgccagaggtacggacatgtccgtccccatcttgtttatgccgggggcggacgaacctttcagacgggccacgtactcgaatatcgtctgagggacggaatggcggaatgagaagaatctctccctgtccttcagctcgtgcccgcaccagctgcgggagagggatccgccgtgggcctccacgaacggttcgatcctccggtaactgtcgatgaggtccccatccatcggcaggtcgaagaaaagggcggaaccggcgtaatccgggatatccggcatatcggtgaagcgcggatcgtcctttctcgatgcacgtatgaggtccagagaaccggagtcgaagaattccaggaactccgggaccacgccactccggggaaaatcacgggacagcgcataggcgtcgccgtcgcggggaaggaagactatgttggacatgaggggatgggactcggtgagatagaggtcggcctcggtgatgaccccgaagatgccttcgctcccgacgaagaggtctacggcatccatgccgtcctcggaaagcatccccgtagtgttcttgacatccctgttgtagtcgtaggaagggaggatgatctccctcccgccgtccgaaaagggaagcatgagtctcctgccttccgcccttatatccccgcgttttacatccaggatgcttccgtccgaaagtacgacgcggaccctcctgacccactccctggtcggaccgtacctgaaagtcctcgggccggatgcgttagtggctatgttccctccgagggaaccgttgagctccgtcggatccacgggatagaagaactccctctcctccgcggccagcatctccgacgccccctcggtcacggaaggtaccgatccggatcccctcctgcgtatgaattcgttgagctgacggacggtgacgcaaggctgtacccttacgaaatacccgcgggcatccttcccgacgcctatgacctcgtccatcctttccatggacaggacatatcccccatatggtacggaaccggcgcacatcccggtcctcataccggatacggtgagggatgtgccgtccgcggcggccatacggaccgcctgtaccacgtccgcctcgtcctccggcaccagcagcctctcggcgtggccccttatcttcgattcgtccataaggtagtcggagtcggaaccgatctcgatctcgtgcaacatatgaatcgttcagcctcggtatcatggccgcggtgaccgactgctccgtaagagacttcctgtccaggagccctccgctgagaagtcccaccgcgccctgcttcttcccgatatcggtggagccgaagaccttcttcacggcatccccgaccgtcatgccacccctgacgtacccggccacctcgggaggatacatgaaacccgatcctgtacccacggtaagccttccgtccctgtccaggacggcacagtattgaaaatcgtacaggccgtcttccttctcgaagacgcctgcctctatgcctacggccatctcgtggcctcccaaggcgttcctggccctgttgacggccccctgacgcgtctgttcctcgaagggctgcggagggacctcgctggacacgtccaccgcggttatcctgacgttgccgaatatcctctccatgacggtacggacggcctctaccttgacgtggttgagggaacctactgcgatatccttggccgcggaggtaccgtcgcgggagtatctgccctcgagtatcgaacctgcgcttatcttggaaccgtcctccgccatgaccagggggacgacgctgagctccagcggcttcacccctcttgacctgcggtactcgttgacctttcttccgttctccactgtctcctcggagaccaccaggacatctacgggatccatcacgtcggccggaccgtacatgtcgtcgattacggcgaccctccaaggcttgcccatggaggacaggaactgctccaaggccttctgtctgagatagagcggtacgatgtcccttcttgtggaagaggccatctcgtcgctggttataccgacgacgacgctgtcgccgacctcgaaggccctcctgatcagctggacgtggccgtcatggaggacgtcgaacgtccccgcgacagcggatatcatctcagagccccacgaccacgaccgccacgatgacgacggcccagaggaccgctatggcggcgatatatctgtagagcttcctcttggcttcctgaccgtccgcatccttgcactcgtcggaacagtagaatccctctccgacgaacgccttcccgcacctcctgcaatgacggtgctgaggtatcttgaccgtatgttcgtccgccatcattccgcctccctgcggtccatctcgttctgcacaaggatcatgcagtggtccgcatgcaggcttatgggccccacggatatcttcgccggccctttggccagaagacactgctcctcctcttcggtaaggtccttgttatccccgaggacgaatatggggtcttccgggaactggaaatccctgacgtcggtgccgtcctccttgaggtagacgaaattccccttccgggaaagtgcctctataacatcggcgaaggacatcttggaaacatataccccgggagaggactggacctcgtgcccctcggggatcttcttgagaagtgcgttcctgataagggaggcggtgctcctctcgtcgggattcaggtatcttacgctgttgccgttgatcctgacggtcttcggggcgtcgtcaccgccctccatgacgagatatatctcggcatcgcggcggatctcgtggctgaggacgaaggccgaattgatgcaacgggcgagtatgtccatcctccccgcacccccggcgaggtcgtcgagcttgaaggaaccgtccgctacggccttgtggccggttatgacgaagtacctcattcctcaccctctgcgttctggagttccttgatggcatcgggatccatgttgccgaactgcttctgcatcctcttacgcatcttcctatccttggagaccgaggacatcatcttcctgctgttgttgtactgcctgaggagttcacggacttcgctggattccacacctgctcccagggctatcctctctatgcgtttccctttgatgagggacggctcctccttctcctggtttgtcatggaatccatgatgaccttgtacttgtccagctttgcctgggaggcgtcgaagtctatcttgtcctccatcttgctcatgccgggaagcatgttgacgatcttcctgagggcccccatcttcttgaccgccttcatctgcatgtacatgtcgttgagggtgaacttcccagaggtcatcttgcgggcgagttcctcgatgtcgtcgctcccgtccatctcctccttggcgatctccaccaatccggcaaggtctcccatccccagaagacgggagatgaaacggtccgcatcgaaggactcgaggtccctgatatgttcccccactcccaggaagacgatcctcgcatcggtggtggcgaccgcggacagggctcctcctccctttgccgtaccgtccatcttggtgaggatcacaccggtgacacctaccgccttgttgaatgcatccgcctgaggacctgcctgctgtccgacctgtgaatcgaggacgaggatcctctcctgaggcttggcggcctcggcgatgtcgctgatctccttgatgaggtcgtcctccagggcgtgacgtccggaggagtcgatgatcttgatcttcttgtccgcgagtttctccagaccgtccttcacgatcttgaccgcgtccttctgaccgggctcgccgtagacctccgcaccgaccttgtcaccgagctgcttcagctggtcgtatgcggcaggcctgtatacgtcggccccgatgagtccgaccgagaaccccttcttgatgaagaaattggcgagcttccctgccgtggtggtcttaccctgaccgtagagtccgacgagcaggatggtctgcggcttcaaggccacaggctctccgttcttcagaaggtttacgagctcctcgtagattatgcgggtcacatgctgcttggatgacttccccgcatcgggcttctcgttgagggccctatcacggacggtgttggtcagcctgagcaccaactgtacattgacatccgcctgcaggagggcgcgctgcagctccttgcagatgtccttgatgagattttcatcgatcgccgacgacccgttaatgcggtcgaggacgttcctgagggattttcccaatccgtccaatgccataatcgaccactccataggtcagacggtatttttaattgtccatggaaaacaagggatggaccgacatggatacatcgaataaacagaatgatacagagaatccgataagtgtgggaacaggccagccagtcagaagggatgggatgcactctacagaactgacctgtaccctagatgatacgattggttatgcactattttaatgttaccacatcttagttgatttaacaataatatgtgctggccattcccatatataatatgtatataggggaaaaggaagaagatccttctgacatcggatatccgatgcccggaaatgagatcaccgggacgcgaccctatggggtctggatgatcttaggggaaatagtttatctccgtcccttgcgggacggatttatggtttagttcaggagcatccggacttctttatggagaaagccaacatcccgatgcagactattgcgaggatggccacaaagacatagatcaccgtctcgctcatctcttccttctcctcatgcaggtagaataccgagaagtcgttggcggtcaccttgaggtacatctgtccgtctatcgtgacggtcttggtgtacatcttggagacgtttccgttgtcggccacatggatcagcgaatagttgtcgccgtccacagggatgtacaatgtggcgtatccgtcataggtcccgttgcggacctcgatcaggtatgcgtcatatccattgtaggtgccggcctgtacgatgacggaaacggtgtcgcccgatccataactggcgggattcagctcgacgacgacccctgagtccattcctatggtcacattctccgtggtatcggggaactggaacacgatggcatcggaatcgaaggtgttggatccttcggacacagtgacctccttaccgcttatggtgacgaggtctaggtcgtaaggcaccatgtagacatacgcccatacgccgttctcgatgtcgactcttccgatggaggtcccgttaccgtcgaccattccgaggagggtcctgttctcggtcttgtcgaaatccgcccagtacactatggtgcctatggtgatgttgtcgtatatcacttccccgtctatggtcagggtgtactcgataggctccgtttcggcacagaccttcttcgtatcggaggttatgccggtgacggtcccgtcggaggcgatggtcattccttccactccggagtattcggcggagaatccgtccacagggacggtctcgtatcctacgatcttaccgtcctcgtagatgactccgagggtgcatccgtagagacaggcatcgaattcgatgccattgacgggatcgctgaaggaacattcggcggattggttccagatcgaagcggggtcgtagaggtagacggttccgttgacggtgtagttgtcggcgttggagaatccggtgcttgtgataaggccgttcatggtcatatcaagcttgtatccctcggtattctgattcaacatcgtcatgaccaacaggaccttgctcacagagcagttgtcgaaaaggcccaggttagccatgcctccctcggcggacatctctatgacggaggtgctgccttccattacggaggtggtgatgagggatgcaccgctgacgaactccatcttcgcatcggccgactcgtaggtcagggatatgggaaggtacaggagggtatcgatgctgatccctttgacctcgacgtccaacgaccttaccatcccgtccttggggtcgtacgatatgcccatcttcccgatggcgagcgttccggtgtaaccgtcttcgttcgctgcataggccacatcgtagaaccagtattttgtgtcgtcatagtatacggcggcgatgtccgcatccaaggtgatgctgatggaagaatccgtgtcggccttgctgttcacaggaacgatggtcgcatcatggttgtagcagacatcgtccaggaacactcccaggatcggatcgttgcgataggcgaatacgattataccgctgacatcgacgtcgatctccctgtcgacggccccgtcggaggtgatggcgacatccctgtcgatgacgagatccgcatccacatacaagaagtagtcgaagaagtcgatatcgcagtgtatcccctccagagagaacttggagcaggtctcggtacggtcctcgtccagatcggcgttgtaactctgctcgagacctgtgatctcgacaacgttttctgcggcatggtatctggtggtctccgcaagggagggaaggttcatgttcaccttgcctatggtgaggctctcctcgatggagaccgtcgggaatgcggcagactcctcggatatggagaggttgtcgacgatctgcatcatgagctcctgcatgaagacggtgtagttgatctccaagccttcgctctccttctgcttcagatcgtctatgacgtcggttgcgatgtttacgatgctggtggagttctcgtcgaggatgaccatgaggtaatccaccgcgagaccgagcacgttgtgggctatgggaccctgtgagatcaggtagaccaccgtatcgacggcgggctcgaggtacttggagatgtacttgtcgaggatgctctcgtaaggtgtgtcgaacgcatcgtcgaacaagagcacgacctcatcgatctggccgaagaaatcgtccaatgccttgtcgaaatccaccccgtcttcgctgatatgggtgtagtatgcgaagaggttggtgacgttcaggaacgacattatggactcggcgtcaagatttatgtggttgtagaagtccacatcctccacgactatgcagttgtcgcctatgtcgacatcgatcagaccgaccccgatgtcgtttgtgaagcaccactcgccgttgtcggcgaatacgagggtatcgcttatgacaaggtcctcgatgacgacggaggtctcctctccgtagaaggcaaggtcgtatgtatcttccctggtgatctcgccggagatccctacatggcacagcaacatatcgttgaacaatgcctcgtaatccttgctgatgaggtcctgatatacctgtttcagacccacgatgtccagttcgacatcgtcgatctctacgttctgggatacggtacctgcgggagacgagacatccagaacgaacgttccgtcgagaccgaggatgctgtcgctgtccttcagaatagggaggtacatgacggcatacaggtccgcggagacgtcgatatcgtagctgccctcgccgtcgacggcctttatatcgttgatgttggcatccacggagatctcgaactcgccttccgccttacactgtatgaggcttaagatagacagttcggggtccttcagaaggtcgatgaattcctggggaccggatacggagatctccagggaggtgtctgcggggatggagacggccatgtcgtccaccttgatggtggcatccttctcggataccgtcttcacggtgatgtctatcgtcttcgtatcgtcgctgccggtgatgacttcgaaaagggcttcgagccctccgcagagggtgaccgaggtatcctcctcgaactcgtagagaggggtgtactcgatctccgtctcaccgtcgccgctgagatagagacctatgccggagccggccttgaactcgaagacggtctgctcggtcgcggaatagactccgaaatagtgggacatctcgtctgtggatacgtcgatgagcatgttgctcccgtccaagaagacgagctttccgccctctccgaactcgtataccccgctgaataccttgtcatcggagatctctacgactgtatccacctttttgtccacgatctgggactcgtaaggggtcttcgctgtgagtgtggcgtagattatgctcccgagggtctcgagagccgacaagtcgataccgaatttgatatcgctatcgaatatgccgccgacggatatatcgccgtcgtcgatataatcggagccaacggcgtcggggacgccggtctcccctgcggaactggtgcaaaccgcagcacatggtacgaccatgatcgctgcgaggattacggccagggccgcggtcaatttactgttcattcaaatcctccatatggtcctgccaaggaccaggtgaaggacggatattcaccatgatagataaacaagagtaccaactgtcatgacaatggatggacgtacatcggaataaatccaacctgtacgaacaaatgagatccataaaatgctgatgaaaagacagaccctccctttaagaagggaggtaaatggtttttttggactttcagaggtatccggacttctgaagggtcatgaggtcttcggtgctgagcttctctccagccttgaacttctcgaagatctccttggcttccttcttggactcgacgtcggcgcgcctcttcttggcggcgttcttcttgttcttgattccgtccgcgctcttgctgacgtcgtggagcgacttgatctgctcgatatgcagcctgtgctcctcgtcggcggcctgcttgcactcgacgaacttcgcctgtgcggcgtcggcctccttcctgatcgcgtctgcgcgctggtacagggagagcatgttgtcgtgtgccttctgggcagcctcggcgtactcggaaacggccttgtgggcctcctccgccttggtcttggcgtccctgagctcctggacgagatccctgatggcctcgtccccttcctcgaccttctccctctgctcgatgttcttagcgagctcggagatctgcttcacgagggccttctccttgtcggctcccatgggcatggtctgctgctgggtctcgagcctctcgaggtccctcttcatctgactgagggagacctctccgcggtcctcgggcttctcggggcggagctcgttgatcttcgccctgatgtcggagaccttcttgttccactcgtccctgacggctttggactccctgaccttctggttgtagttgtcgcggacctcgcgggactttccggcctcgtcgacgagctctctgacctggccgttgagggcatccctcttggccttccagtccttggtctgggcgttcagctcgtccctgcgctgcctgtgcttctcggcgtcgtcgttcagaacggtgcgctgagcctcgagttcctcgagcttggccttctcctcggccgtaggctcggcaggctcttcgacctgctcctcgactttctgctcctcaacgttctcgaccgcatcgatctgctcgtccttaaccggggttacttcctccgcatctaccataaaaacatcactcattgttcattttggccatgattcaaagcgtggcccacttctaaaggtgcctatattggtatcccttataagcatttctaaggattgggaggatttccccacacatcgtacacccttgtcgcacatatggaggcgatattcgcgcgatatcggggcatccgccctgcggaaacggacacggcgcggacgtccagacgcttcctcgccggcccgtgaacacgatctccgggacatctccgcatgtgcataccgcccctccggatacggcgagacatccgtccaccccggggatgacgcacaccgtctccgccgcacgggagaggtccccctctccttttatctcgttgccgagacgggtcgcacacgcatccgcgaggacggggtcgcgggagacgaccgtcgcgatgtcggaatcgccgaagctcagggaaggccctatgctggcggacgaggagcagatccccaggacgccgtccgtacatgggatccggaatccgaaggacgaggtatccttcttccccgtatagagccctattatcacttcctcctcggagaacagggctatgtcgccgccgttgtccgcgaccgcgtaggtgcatccgtcggcgacgagtccctcgacgacgtacagggcgaccgcacctgcgacggaggccatgggaccgacccccgcatccgcacccgccttgcacatcctcctgacaagaggggggtcggaggcggaggcctcgaccggtacgagggacgtcccgaaccccggacagcggccgatcttctcctctatcatcccgcgggcttcggatatcaggtccgggacttcgtcggcgaacgattcctcggtacagacgtcgagacatgtttcgccgacaactatcctccttctcaccctcatatggcgcccatgaaacggtttctgatctccgcggcgctgtacgggatgttcggagaatccgaattgaacggcactatgaacacgtggacgaacgtctcgtccccttccatgagtctcgttatgctctcgcggtcggatgcgtcccccctcggtatgccgtaggcctcggccacggcccccaggttgacatccgcatacgcctggttcatctggttcccggtggagccgaacgtcccgttgtccaggcacacgatcttcaggttggagggcctcagtcccgacaggaccgggaatatggaggaacccagaaggctcccgtccccgtcgaccacgaccacgcgcctgtccgtgaatagggacatcccgagaccgatgggcgtcgcctgggtatagctccccagcatgtagaagttgagaggcctgtccttggaggccatgacctccttggaagggactcctatgttggagacgactatgtccccgtcccctacgcagtccatgaccgcacgtatcgcttgcagacgggtgagggatggctcggccacggtgtcgtccatctcgatatgcctcgacctggcacgcggagggtaggtcactccgaccctcttctccccctcccacagcttgggatggatgagcaccacgtggatctccgaccttccgaacgcctccctgatgctgtccccgacgcgcggtatgtcctcgggaccctccacctcgcaatggtgtatcccgtacacgtcgagcatctgcggtatcttggagttgaacggtatctgggcctcgatcttctcaccgtccacccccctccagctggcgaggaccaccagggggagcttgtagcagtcggtgagggacatgagggcgttcatcatgttgcccagccccgaactctggatcgatatgacggcgcgcttccccatgagggccgcaccggcgcagatgcccacgccgtcctcctcgcgggtgacgtccacgaccctgaactcctcatggatcaggtccgtgaaccccttgttcttgtcgcacgggaggctcactatgaggtcgacaccctcggacctcagctgatcggccacttcctgctcatgcatcgacgatcgccctcagttcttcatcggtgacgtccgtatccacatcggccttgggtgccacggtcacgaggtcgtagtcctcggagaccctgtcgcgtccggccccggtcatgttgaggaacacgcactcgtccctgtccacggtgccgtcgccgacggcctttacgagggatgcgagggccacggatgcggcggggtccggacggacgttctcgcactgcatccacatcctctcggccgacctcgcctcgtcgttggtcacttcgatgaacgacccgtcgcatgcggtcatggcatcgaacacaccccctttcatcgaataggggggcttgcggttggtaaggacctccgcatagacctgggacacgtcctccctctcctttccgaggtcctcggggaggatctcccgacggccggcgttccaggccttggccatgggggtgaacggaaggttctgggacagacggagcctcggcagcctgtctccgaacctcccgtccccgatgagcctcagggacgcctcccacgcggatatcccgccggtaccgcttccgacaccctggaagtagctgtcgggcagcctgccggcggtctgtgcgaactgcagcatgaccgtacccataccgtcgcggcgtgcgacgttcctcgcacccccctcggacacgaagtcgcccagggcgacaaccctgtcggcgagggctatcgcatcggcatagtcccccttgacggtgatcagggttacgttctcggacctctcggtgacggtgagtttgtccgcagaggtctccgggaccactatgatgcatctgttcccggtctcggccgcgatctgcgcgaaggccctcgcggtgttgcctgccgaggcgaggacgatggtcttgccgccgctgtccctcagacgggcatatgtggggtaggcctccatctccttgaatgtgcaggacatggacctgcagtccctttcggggtagtatccggtcagtccgacccagaggtcgttgagacccagttccttggacagcttctcgctcctgaacacgacggggcacgaatccgtctcgtatacggacctgacggggagccagtcgtagaatttgaatatccccttgcatggcctgggggagaattccctgacctcgtaccgggtcctcatcagacccttgtgtcccgacgggcagaagagcccgtatccgtcctcgaagacctccccgtcctcctgacataccagttcatattttcccattgacatccctcagtttccagtttccgttctccaccattcccttcaattcgacacacaggtcctccgccgccgagcgggaggactgcctcacccctatcgggaccgtcctcccgtcgaacgatacggaacccatgtctgcaccgaagacgccgcctacgcatgtgtatgtgcagagtccgcaatccatgcagaggtcgttcctcctgagtgcggacggcttcgcgtcgcggggacaggataggtccgcctggcactccctgcacccgagacacttcgccgggtctatggagaccctgtggtcggtacccttccataccgaggcgtagtcctccctgaaaagaggtttcctgtccctcacgtccgccaccgggaggtatacgtcctcgtcgagtacagacacgccctccagacccttctccgacgttatcggtattgccgatgcgacggaggtcaggcattcggggccctcggaggtcctgaatccccccatgagctccggcctcatctgatgcatgtccgcctctatggacaggttgggcttctccggggagctgcgggtcccgcatcccaatatcatggcgggggccccgttcagcagggcggatgcgcccggacgcagatagagcagctcggggtcgttctgcaccgggtttatctccccgcatccgctcaccgacgcctccccgaacgacctcctgagcggacgggggccggagaatatggtggcatagtcctcgtcggagaagttcgcgaaacatgtataattcttgaaacacccgcgggtcaggaccatcctcgcgaaggggatctcggaaagcgtcctctccgccctgtaggtcctgccctcggcggagacctcgacctctatgctcttcccggcgaccatgtccctgaaaagatgtccgcctccgtacgaaccgtcgcggcgcgatgtcccgtagaccacgcagtcgacgaggcccagggactcgttgggacatggaccgaccgtggcggggacgccgttgagcgtgatggtgtccgcacgcttgaaggtcccggcctccgccacggggacacacagtatggccatagtcccagacatgactccgaaggtcccgcaggtgaccacatcggcctccctcgaggaggggtccctcctgcggaccatgtccttgaactccgatgccgtatacaccttggccctgcgggagtctatcttcttctggaccgattccagcgaatccccgatcacagtatcaccacgtcctccaccctgacatggatgccccagggtttatcgatgaccatgttcaccaggcccgtatgggccctgtccatcatacagaacccgggcaggaagtactgtctcttcccgaagcacggatccgccttcatggggagggcgcggccctcgaatcccagcatgtggtatgccttgacgtccttcacctccctgtcgcgggagtaggcgggacccaccacatgccccgtgatcacccccgtatcgtagtcggcctcggtgaccattatcacatgctgcacggggcatcccgcaccggcaggcctgcccgtgactatgtctcctggcactatccccatcctctcggtgatgtcgggcctgaacggcaggacgatcttcctggccgagcactccccgggcatggcggtgatgacgaagtcgtactcctgtcccaggatgtcttttccggagtacctgcgctcggtgtatccgcggacagggagggtgttgacgttgtagaagggacatttctccggggatgccgaaccggacctcaggagtgcctcgaaatccgcacatgtgcgggagccgcaggccccgcagttcctcccgggaggggtccaatcactcgccgttgtagatgttgtcatcgtcggccaacctcctgatgacgccgaagtggttctgccaaccgatcttcttcttcccgatgcacacggtgcataccccgagagggggagcgcccctgagttccagggaatccatgtcctcgcatgcgggggcggaatccatcaatctgtagagatacttcagaccggtaccctgcacggcgttcgtctccacgatgtccatgtccttggagacacggcggatactctctctgaacacctccttctccgcctgcgatatgaggtccgtcttcgtcaccacacatgtgtcggcgagggctatcatcggcgccatcttgagaggtgcatgggtcccggaaagggaggacatgacgcatatacccagagccccggacaggtacggcgtgcatctgagacacaggcctgcgctttctattatcaggacggaggcaccctcctccccggcccatgcgaccgcgtccctcatgaccatgatacccatgtggtccgggcacatgtccccggaatagaccttcctggcgggtatgccgaattcgctcctgagctcctcgtcctcgaatgcggcgacgacgtcgatcttcagatatgccaccttgtccttgtccttcagatagcggatcatctgttttatgacggccgtcttcccggcgctcggaggaccggccacgaccattatcctcagagtcactgggactcaccgcctatgatctcgcccatgcggatcctctccctgatctcggagatctcgcagtccatacgccttatcttctccagggtctccgtctcggagttcccggggtagaggacggccttgacctcccctccgcgcatgacgatgcggcggtcggacaggagggacacgtaggggtcgtgagtgacgaagatgaccgccttgttcttccctttaagtctggttatgacctcgtccttgaagatcccggcgttctcgatctcgtcaagaagcaggatgggggtatcggatatcacgaccgcatcggcgatcatgagggaacgggtctgccctccggacaaagatgacatcctggcactttcgactatcttctcaccggtgaaatggttggcaagggcgatggcctcgccgaccgcgttctcgagagggttctcgcgggtagagacgtgcatggagaggaactccccgacggtcaggtccgcaaggcatttggtgttctgggttatcatcgctataggcttgcaggccgggttgcggatgaactcctccggaggcacctccccgttcaccaggaccctgcgtccggtgacggtgtcgccctgggcgaacacctcgatatcgtttatgaatgcggtcttgccggaaccggtgggtccgacgatggatatggtgtctcccggagctatgcttatgggttcgaaattctccggtcttccgtctttggttctccctggatagaccgtgatgacaatgttctcgaaggaaggcatacgaaacagttggattcgtaatatttaacctatttgagatatattttcctaataaggataataaccttaaagggttatccttgcataattaggatatatttcccggcccgcatccttctggatacggccccgcggaatcggggtccccctgtacatgagacgttctggaacagacggcggccgtccgtcccttgataggttttattaaataatctaagcctatccacacctaggataatatgagcgattacgtctgtcctttggattacaggtacggtcgcgaggagatgaaatcgattttctccgagaccagccgcatcaactaccagatgaaggtcgaggccgctctcgccagggcacacgccaccctcggagagatctcacaggccgacgccgacgagatcacccgcgtcgccgagtccggagacgtgaaggtcgagaggataaaggagatcgagaagctcaccaaccacgacctcatggcgatggtaaaggccatgacggagcagtgcaaaggagatgcaggcaaatatgtgcatctcggagccacatccaacgacatagtcgacacggcgaccgccatgcagataagggatgctctcgccctcgtggccgaggatgtcgacgagttcctctacaccctcgccaaactggccaagagggagagggacaccctcgagatcggcaggacccacgcccagttcgccatccccataacctacggattcaagatcgcgggatacatcgcggagatgctcagatacagggagaggctcgacgagatcatgcccagggcatgcgcgggcaagatggcgggggccgtcggtaccggtgccgccctcggaaagaacttccacaagatccagatggaggtcatgcaggacctcggcctcacctacgaacccgccgccacccaggtagtcggcagggacagatacaccgagctcgtctgtctgctcgccaccctcggtacctccctcgagaggtatgcgaccgaggtcaggaacctccagaggtccgagatcggagaggtctccgagtacttcgacaaagcccatcaggtcggaagctccaccatggcccagaagaggaaccccatcaactccgagaacgtctgcggactcgcgaggatcctcaggggattcgtcatgccaaccttcgagaaccaggtcctctggcatgagagggatctttccaactcttccgccgagagattcaccctgccccatgtgttcaccctcatcgactacatgctctacaagatgaacaaagtcttctccggactcgaagtccacagggacaagatgctcaggaatatcgcctccgcacacggactcatcatggcggagcccgtcatgatggcgttcgtcggaaaaggcatcggaaggcaggacgcccacgagatcgtaagggaggcctccatggaggcagaggacaaggagatcgacctcctcgagaccctttgggagagggaggtcgtacgggagcacttctccaaggaggagctcgctaccgtcatggacccggcaaactacaccggcggctccaaggagatcgtcgacaggatggtcgacgccgtggagaacgccctcgagaagaaggtcgagtgatgaggaccaccgcgatgacgaggcacaggatgaaggtcgccgccgtcatcggcggcatagtgggagtggcacttttcatagtcgcatggctctcattccatgcccccatccacgtcatcatcgtaccgatggcggccgccataggtgcggcgaccatctacctcggcgacggtcccgccgaggacgattaaaatcatttgcccggaccctccggagaatcggagggccgggtctttttttcaaaaacggatcactgttttagtttctctccggcatgtacgccgggggcggtgtcatagacatcggtgacgatgatctttatgagacccttcgcagggaatgcgggattcttagcatgtgccatctcgacggcggccttatagtcgtcgccaaaatcgaagtacctgacggcacccttgacctgtacgcattcgtgtcctccctccccgccgatggcgtatacggcggcgacggggttctccttgatgttcgcataggtcttgttcatgtagttgtcgatgacccagatctccttgtcgttggcgacccacaggaaccctatggggacgacgttggggaccccctccttggaagaggtggcgagggcgaagtatttgaagttggacttgtggtcctcgaagagggccttgacttgaggcgagatcattgccataatcggacgaatgtcgtatcagaatatacgggttttcgataggccggtacccgcggaccggcaggaaaacggcctatcagtgtttcttcgcgtaggcgtccatgcaggcctggatggtctgcttggcggcctcgggaccttcgatggctcccgtctcggtcttcttgccctcgagggccttgtagacgttgaagaagtgctggatctcctcgccgaggtgcttgggcagctgggcgatgtcggtatactccttgtacatggggtccttggggaggacggccaggaccttgtcgtcctgatcgccgctgtcgaccatcctcataatcccgatgggcctgcatttggcaagtgctccgggaatgatgggctcgctgctgatcacgagaacgtcgagcgggtccccgtcgggtgcgacggtcagggggatgagtccgtagttccacgggtatgcggtggaggtggagaggatcctgtcgacggcgatgaggccggtctcctcgtccagttcgtatttcatcttgcttcctttggagatctcgatgaaggcggtgaactcctcgggctttaccctgtccttggacatggtatcgactatgtttgccatatccgagcgatatttctcgtattataaaatgattaagaatgccagatttcaatcgccatccctgcggcactgcacggacacaggacattggaaccgcccggacatatgacaaaagaccatcaccagaacaaatgtatccttattgtataatctttatccaaagataaatatatattctacacgaatccaaaaatcagaaaatatgtctcttacaccttctcaacagaaactggtgtctacctcagtcatcatcgcggtcattatcgcatcgatgggctgcgtaatagtctatgacgaaacacgcagcgacgaccagggatccaactccgtttacaacatccttgcaagggtaaattcggaaggatccggaatctacatgaacaacgatatctacgaagacctcgtagataaagacggcaatccggtaagcgattcgatacctgataggaacggcgttaatttctacaaggtcaatgcagacggcaccaagtatgtggacgccgactgcaaggccgcatggggaggtctgatctgcggcactcccggaaacacatccatccagcatgtgcagatgaaggaaatggtcgaaaagatggggctgtccttcattctttatgaaacaggatcctccctcagttcctcgtccgtgtattacatcaataccatcgtgaactacgacaaggccatgaacagcgagagcaacaacggagtccagctcgacatcggaatcctgtgggaaccgcagttctcctatatcgtggacgtccctagcaccgagacgttcaagtccctcggactgaccaacgacttcttccccggacatacctgctgcgtcctcggaggatacacctcctacatatccagccactccgaggcgaccgaaaggttccttgcggcatatgtgaaaacggtgcagtgggtacagaacgccaacaaccccatgaccaccgagatggaccccctcaatccgggaaagaccgtgtatgagaccctcgtgagcacctgcgcccaatccaccggactcaacgaggacgtcataaaggatgccctctccagcatcgcatacacatacggggacgacgacgggaatggatccaccgacctccacctcctcaagaaggacatatccggcatagtcaccagcaattccagcaacctgaagtattcgatggaagacctgggattccagaactccatccagttcgccaacagatttgtggacgaatcctacctgatgaatgccatcgccctcgatggcagctctctcaccggctcgtacaggataacggtcgcggccatctccggggacattcaccagatcgccctccaggtgggattggccagagacatattcgcagaatacggagtcaatgtcagcgtcgcataccaatccaacggagcaggtgtggcagtcgcattgcagaacggatccgcacagttcggattcctaggcgctccccctgcgacgatcaccgcagtaaacggccagctcatcacggtctgaagaaagcgatagtatgatgttcaaatacgacaagcacaacaaatatcacaggcttctgagacagatcctgataattgctgtgtcccttgtgatatttgtggaggcgtggtgggtcgtatccataatcgccgacgtttccacagtacctacgccggcccagacgtggaacgccctcatcgacctgatccagaacggggactcgatgacgaacaataagactctctggtcttacataggatccagtatgagcacattcctcaaaggattcggactcgccctgctggtagcggtacctttgggactcatcctcggaaaattcgaatccctgagatcgttctccactcccataatcgagatcctgaggcctatcgcacctatcgcctgggctcccatcttcatggtggcgatcggatacgatctgggacctatgctggtggtgttcgtcgggatattcttcccgctgctgacgaacgtcatattcggggtatccaagatagattccaaactggtcgacgcttcgaagactttgggcgcatcggatacccagatcttcatcaaagtgatggtcccttccacgattccatacataatgaacggtatcaaggtcggtctgggtatcggatggatgtgtatcgtggcggcagaactctacgcttcccctctgggaggtataggattctacctttccgaacaggccaccgcaggatattggccttccgcatatgcggccatcgccgtgattgcagtactgggacttctcaccacaggggttgccgagtacatccataagatggtttccaaaagaatggggatggacgtatgacatccgaagaacagcctgagataataacgaccaagcccaagatcaaatcggggaacagggtcagggccgaccgtaccgacctgctttacaaggacatcccagaaggggagtccctgatgaagatagacaatctacgcgtggtctacaggaccgacgacaccgagaccgtggccgtggacgacttctccctcgacgtcaagaaaggggagctggtatccatagtcggaccctccggatgcggaaagaccaccatcctccgctgcatcgcaggacttctgcagcccacgagcgggaagatcaccataggggacaaggaatgcaccgcccccggttccgacagaggcatggtgttccaggacttcgccctgttcccatggaggaccgtgaagcagaacgtggagttcggaatggagatcgccggagtccccaaggaagaacgcgaggagagggccatgagatacatcaaggccgtcggactggagaagttcgcggactcccgcatacacgaactgtccggaggtatgaaacagcgtgtcggtatcgcccgtgcgctggttatgcaccctgcggtcatcctcatggacgagcccttcggagccctcgacgcccagaccaggaacatcatgcaggagcagctgacgaagatcatccagcacagtgccaggaccatcatgttcgtcacccactcggtagacgaggcgctgtatctttccgacagggtcgtgatcctgaccaagaggccttccaccatctacaagatcatagacgtcccgtgggataggccccgcgacagggcggaccccgaattcaccgccctcaggaagaagatcctggaatatctggagatgcagaacgtcatggaagactgaacgtctccgaatcttccaaaaaaccgtttaccttcactttttacaatccaatccacttcttcggcactggttattaaaataaccgagcagatagggaacatgatatcggtacgagagggttccagtgatcctgaaatattttaggaaaagggattgggcgctgacagccgcgctcgtcgtcttcataatatgccaggtgtacctcgatctggagatacccggctacatgaacgacatcacgtacgccatccagaccgggagcggcaccgatgtcgtaaaggaatacggaacagacatggtcctgtgcgcattcctgagtctcggattctccgtggcggcaggattctgtgccaccaacatcgccgcatccctcggaaggaccctccgcgagagacagttcgaccgcgtccaggaattctccatgcaggacatggacaggttctccgcggccagcctcataacccgctctacgaacgacgtgtatcacctgatggtgttcaccgcgagaggtctgcagatcgtcataaaatcccccatattggccacatgggcccttctcaagatctccggtaagaactgggagtggaccgccgccaccgccgcggccgtcgtcgtcctggtggcggtggtcgcggtgaccatgtggtataccgtgccccgcttcaagaagatccaatggctcaccgacgggatcaaccgcgccaccagggagaacctggacggcatacgtgtcatacgcgcctacaacgccgaggagtatcagcagaagaagttcgacaaggccaacgacgacctgttggagaacaacgtggccaacgcccatgccatggcccccatgcatccgataacgtcgtccctcaacaacttcctcaccctcgccatatattggatcggtgcaggactcatcgccgcggccggaagcacaggcgacaagatggtgctgttctcggacatgatcgtgttctcctcctacgccatgcaggtggtgtcggcgttcatgctgatgataggcatcataagaggtcttccacgggccatggtggccgccggccgcgtggaggaggtcatagaggccgaaccgtccatcaaggacggcggattcgacggggtgacggatgcggaaggggaggtggagttcagagatgtaggcttctcatacccggatgcggaaggtcctgcgatagaaaaggtgagtttcaaggtaggaaagggacagaccttggccataatcggtcccacaggttccggcaaaagcacccttgtgaatctcatacccagattctacgatgcgaccggagggcaggtcctggtggacgggatcgatgtccgcgaatacgatcagaaggccctgcgcaggaggatcggatacgtaccgcagagcgccgtcatattctccggctcggtggaatacaacgtcaactacggggacacctccgcggacaggaccgaggacgatgtaaggaaggcgttggagatagcccaggggatcgatttcgtcgagaagatggaaggcggaatggacgggcatgtgtcccagtacggcaggaacgtctccggaggacagaagcagaggatatgcatcgcgcgtgcggtctgcaagagaccggagatactgatcttcgacgataccttctccgcattggacttcaagaccgatctggcacttcgcgaatccctgaaaagggagacggccgggacgaccaacataatcgtggcccagaggatcgggaccatcatggatgccgaccgcatcatcgtcctcgacaagggtaaggtggtaggcgatgggacccacgaccggctgatgaaggaatgcggcatatacaggaacatagcgatgtcccagatgacgggggaggggccggaatgagtcctccaggaccttccggcggccagacgcggcccaaaggtcccagatgggccgtgggcgagaagccgaaggatcttaaagggaccatggtccgtctcttgcattacatcgggaaataccgccgcgacatagcgttcggcgtggtgttctccataaccgccgcggtcctcaccctcataggaccgcagtatctggcacaggtgaccgacctcgtctccggatccatattgggagggacgtccctcgatctgggcaggatcggggggatatgcctcgtcctggtattcatctactctgcgagcgtcatcttctccacatgtcaggaatacctgatatcggcctcttcggagaagatagccaacgtcatgcgcgacgacctgtccaggaagataaaccgcgtccctctgggatatttcgacagaagcagcacgggcgacataatgagccgcctcaccaacgacgcagataccgtcgggaacacctgcagcgaaagcatcgccctcttcatctcgtccataacactggccgcaggttctgtcgcgatgatgttctacaccgacccgaccctcgccgcgatatcgatcgtcccgacaggggtgggattcgtcctcatgttcgtcctcataaagaagtcccagaaatactacaggagacagcagggggacctcggggccatgaacggtctggtggaggaggtctattacggccacgacatcgtgagggcatacaacggggaggcggggtccaagaagaggttcaccgccataaacgacagcctctacacgagcgcgttctacgccaggttcatgacgagcctcatgccgcagatgctgaacttcatcagcaacatcggttacgtcatcgtctgtatcttcggatccatgatggtcatcgacggaaggatcggatacggcgtcatcgtggcattcatcgtctatgtgaaccagttcacaagacccatactcatgatatccgaatccctgacctccatgcagtcggtggcggccgcctcggaacgcatattcgacttcctggacgccccggagatgggggacgagggttacaaggacgtatccgtcgcaaatgtaaggggggaggtggagttcagggacgtacatttcagctacgtgccgggaagagaggtcatccacggattctctcagaaggtggagcccggacagaaggtcgccatagtcggccttaccggggcgggaaagaccaccatcgtcaacctcctgatgagattctacgaggcggacagcggggacatcctcatagacgggatacccacgaggtccatgaccaggtcccaggtccacggactcttctgcatggtcctgcaggacacgtggctcttcaacgggacgatcagagacaacatagcttacaccaaggaaggggtgtcggaatcggacatcagggccgcatgcagggcggcggggatagacgatttcataatgggtctgccggacgggtacgatacggtacttaccgacggcatgaggctgtccgccggacagaaacaacagatcaccatcgcaagggccatagtgcgtgacgcccccctcctcatcctggacgaggccacgagttcggtggacaccatgaccgagaagcatatacagaacgccatggacgtcctcatggagggaaggacgtcgttcatcatcgcccaccgcctctccaccgtaaggaatgcagacctcatcctcgtcatgaaggacggcagcatattcgagaagggtacccacgaggaactcatggggatcggcggattctacaaggaactgtacgacagccagttcgagaactgcgaatgaacatgacaagaccacacagaccaagaacgacggcccgttagtgtgggttaagggatttgtggtgcggtgcagtagtggatgcaataacattattgcagaattagtatataaatattatttaaaaattggacatattaggaataataattaaatatcataagtcgcttgttccgctttctcaggccatttccctaacacatgttgattataattcgccgcgaatgttcacggatgtcgtctcatcgatcggaatgacgaggtgaacagcataagctgacgatagaagagagtcctgagatccgtcggtgcgtaaggcacgcctgcggtctccatggccgccgtctgcttgtcggagagatgcgtatggggataactgccatagaacagcatcatgagtccctcgaggaatccctcccgcgactgctccgacgcatggaaattagcatccatgaatccgcagatgtactcgatgaactccctgaaataacccttgaatgcgacgatatgggatatcccgctcccgtcctctatgagtttcaggtcggtgaagagcaggaacatgttctcgtgctcggcagagacttcgcttatgatacggcagaacctctcgcgggacacgtctcctgacgacagaccgccctttatcccatccagccacccgacgaaatacctggtcagaagatccatcatgacctcctccttggtatcgaaatagttgtagatggatgggcgggagaaggaagtcttctcggatatcgccttgaatgtgacggcatcatatccgccggccagatagatctcctcgcaggcgctgattatctcctcgcgtctgtctgcgatctgctcctccgtactggccctgacgaaatccttcatcgcatccgacatcgtgtcaacggataaaaagagaatggaaagggtttggaaacggctccgtatggggggatcgtcatccgagtatgttagcggcgagctcctctatctgggcctcgttctccttgctcatggccgagtggatggtcaccttgggacctacgatctccacaccttccatggtctcgagatgcttggccatgaatttaccggcacaggggccgaaggtcccgttctctatgatcccgaccttcctggactgatacttcttcccccctatatccaggaggaacgcctccatctgcggggcaagacctccctcgtaggacggggcggcgacgatcatcctgctgtagcggaaggcggcctccagcgcataggagacgtcggtgtgaacaaggtcgacgatctgggtctcgacgcccttgtccttgaagatctgacatatcttttcggcggccttcctggtgttcccgtagaaggatgcgtagaccacggccaccccttcggtctccggacggtaggaggaccacgtgtcataaagtgccagatatccggagaggtccccttcgaggacgcatccgtgcagggggcatatcttctttatatcgaggggggagagcttggcgagggccttctggaccatctgcccgaacttcccgacgatgttcatgtagtaccttctggcacccttcacccaatcgtaggcggggtcgtagggaccgaaccttccgaatgcgtcggccgagaacaggatgccctcggtgggctcgtaggacattatgacctcgggccagtggaccatcatcgtctcgacgaagtgcagtttatgcttccccaggtcgagaacgtcgccttccttgaccacgtcgcacttggatgacatgtcctcgttcatgaactgggacatcatctttacggccttggcggaggttattatcctcacatccgggaacatggacaggacggtcccgatgttggcggagtggtcgggctccatatggtgtaccacgaagtaatcgagtttcctgccgttcaggaccttcttgagatccgagacccattcgtccgtgaccttggcgtctacggcgtccagaaggactgtcttctcgtcctctatgacataggtattgtatgtgatgccttcgggaatcgggtatctggcctcgaagaggtcgaagccctggtcggcctcggagatgagcgttatctgatcggctatcttggatatcattggattatcctctgcgtgtccttctccgttcaacgatattaacattgctggagaccggggcgcacatatgaccgcagtacaaacacctacatacgttaatacaggacggtctgccggaacctctccgggaaggagtatgcgtaccccatgcacgcatccggcccgcacatcatcccgtgcctgctacatctctccttcaggacggacataagacggtccgccgaaggactgcggagggagtatgacgccccatacgttctgatgtacctctccttcatacccgggaaatcccggtccaaggcatcatagaagtatccgcggtcgccgtccctgagcgtgagtcccatgtcgaagcatacgatgcctttcaccccggcctcggcacagcggtccgctatatgcgagacgttctcctcggtgtcgtttatgaacggcagtatgggggtcatccacaccaacgtgggtatccccctgtccctgagcctgtcgaggacctcgaaacgtctggcagtgccgcagacatccggctccaatatgcgacacaggtcttcgtcccaggtggtgacggtcatctggaccacggccttggccttccggtttatctcgtccaggatgtccatgtcgcggaggaccaggtcggatttggtgatcagcgatatgccgaatccgcggtcgcggaccttctccagacacctcctggtcagcaacagttccctctcgcacggcatatatgggtcgctcatggacccggtacccaccatgcatttccgctttttcgatgaaagctccctgtccagcagttccggggcgttccttttgacctccacgtcctcgaacggatggctgaatccatagcaagtactgcgggaatcgcagtatatgcatccatgggtgcatccgcggtagatattcatcccgttgcgtggaccgagaagggtcttggcttccgtgaaatgcatcagacggtcagaccccacatcctcttcctcggacccctgtggtacatcctccctcttctgggtatgtactccatgaggctatccatgcacggaccgggatccgtcccagacatcctgagcacgatatctgaagaccacatcctctcgatgtgtccgcttttcatcctgccgtcgaacgactcgatcatatcgtcataggcgccctcataagggaacgggacacccggcataccgtgctccttcacacggcggagacactcggccttaggacattccacgatgacgaccagcctttccctgtcggaggagcggaggaacgcttcctccgtattgtgtccgaagccggacatctccaccacgcaatccttatggcggcacatgtcgtcgagaagtctcctctgcgcctccgtctccccgtccatggtcccgtccccgtaccttccgcgatactcgtccagtaccagagggacatacttcggacgtctggcacatatgtcgttgaccaatgtggtctttcccgagtgtatgttgccgaagacgaacacgatcatatgcggatgatatgtccgtacaggtatatttggtgtaggtcgttatcggaaaagggcggaacaggtcttttccgcacgatctatcatgcccaaaaacctctggatgtgtttctggacaccaggaatggaaccaaagacatcgatttccgggatccctgtggaagtgtgacggaggaatgcctccatatcgcccccggatgtctcgccgcaagcgatcggaaatatccggaatctagagatctggcacatatctgtcactgtgcagggacgcatatcccggatacacgtccgcgttctccggaatgtatgcgatgatgccccacttacggtcaaccggaccctgttgccgcaaagaccgatatccgcatcgaagatgatccctgcgacggatcggccctgcacatgccccctgtccgcagacggccggtcattcggacgtttcctgtcctgcacctttgacggatccgggcagagggaccttggaacctacgaatgtggcggcggccagcaggacgacgctgtgcagggggaaacacaggaacagaagcaggacggccatgagaggacgtctgacgaccccgcccaccacggcggccgtcacggcacatacgcagaatacggggtcgatacccaggaccgaggccatgccgtagcctatcgatatcccggcgaacaccgtcggaaagaaatgtcctccgcgccaccccatgttcacgcagagcgcggtggcggcgatctttacgaatcccgtcgccacaagcactgcggcggacaatgccgcccatgtcgcattcagctcatccgcctgtacctctccggagaacatgacgaatgggagggccatgccgcagagtcccagtatgacaccggcggtgacggccttggcgaccggtctgtccccggcgagttcggagatgcgggagaatacggcatcgaatatgtggaacagccatcccgcgacggcaccgacgaggatcagggggaccgcccatatcagctcctccttcccgaaggatatgtcagtatacctcgggagggacaatcctcctccgaacatacgggtcaggagaaggaacgctccgaacgcccctccgacggccgcggcatagatggcccatctgacccatttcgacgcatacgggtcgcactccccgtcgccgtccacagcgccggccaggccgtagaggggtgcggtgaatatcgcggaaagggcggcataggtcccgaccctgctcagctgaccgaaacctctgccgaaacgtctcagacggtcccccgcccaggtgctgagggcggcgacggcaccggtaagaccggcctccggaccgacggacccgccgaatatcagaggaagggccgcaccgacggacatcctgcctatcttgtcgtatccgtaacggccatccgccttcaccttccccaaaacggtctgaaggctttccgggtaggggccgcagcgtttcacgaaaaatcctatgaccgcaccgccgaccgtgcacatgatcagaggatagaactcccccagatacacggggaccctgtcccatatggacgatatgcctaggtcgatgacgaacagaagggcccatacgaaagcgcctacggccacccccgtaacgacggatgagacggcgaaagccgccgtgttggctgccctgaccctgtccatgacgaggtcatgacgggtatgataaataggtttgtggaaagaacaggctgttgaacatcgcatatccgctccgtcggatgtcactcggctctgcgatcggatttttcaccgagatacggtacgtcgtactcgggtcattcttgctgcggatcccatcgcggtcggacttttgaagaattgtcctaccgaccctgacgatcgtcgtatcggtcacatacccgtctcatcacacatgccttctgccttacgacatccctgtcggacgattagctgttgaaataatcgaagaggtcggacctgacctcgtctttcagtctgtacatgatcttcacaggtttctcgtcgttcatgaacgatacgaaatccaattcaccgagatagtagaattccttggagccttcgtctttcttgttcttacgtacgaaaaggtgtatcctgacgtcattattgacctggtcccccacacacaccatattattggcacccttgccctctgtggatttggagaatgcgatcagggtgttcctgttctcgaaatggtcatcgtaacgctgtgattccacaacgtcctcccctttcacatagttgatgaatatggagaatgtgttggtcgtcttgtcgaacttgtatcctccgatagtctgggcattcacattggccttccaattcatcagcctgcagacatcgtcgtatgtatacatcctgttcagcacgaaattggtatcgcgatacaacggggagtatgaggtattgttgtccagacccagatcaatcaggtcctgtacggcctccttgaaacccgcctcttccatcatgtgaaggaaatcgtcacacaccttgttctcggagatcaatttgatgtcgtttttatggtttttatggtttttatggtttttatggtttttatagaatgtaccatcgaaaaccgatacgatgttgttcaacgcgttttgatccagttccggatgcatctcctcgatacgttctttgacactgtcgccgccggaacatatcatcttcaagacctcgacctccaagacccttttcccaggggcgatgatcttggtgagatactccagcatctcctccgccttcggagagaatgcggtatgatagtccttgtccttcttcttcaggaaattatgatatgaattgtgctttaacagaatgttgaggacgtccatcgaaccgtacttcctgaattcgatgagcttggggatccgtccgagtttggatttgagttccatatatgcctccaccaggatggcatccttggaaaaactggccttatctatcgattcatagatcttggctttcgacacctcgtcgaaacttatggtcgagttaccgtagattatgctgtccccggatgccacgaatcttctggcctcgatcttgctgtaggaatggtcgtcagagagggctatcgggatattgtagttcttgtcatagttgcctatgaagtcgaggacggtgacgaaatccttacctttgtcgagcctcaatccgcgccccagctgctgtatgtacactatgggggattccgtaggacggagcattatgacctggttgacggaggggatgtccactccttcgttgaacaggtcaactgcaaagatgtagtccaacgcatagtcctcctcgtccgactccaacctctctatgaggatctcgaggacatccttgtctagactgccggatacccaggcggtacggtatccgcgtctgttgaacatggtggagaacatctcggcctctttgagggtgctgcagaacgccaatcccctcaaacggtctccgccatgcccatagaattctgcattgtctatcacatattcgaccctcttctcgaactctatgtccgagaaacgagagacgtcgtcgagggatacccctcccacctctatgtccgatataccgaaataatggaagggacagaccagattgtactccatggcctgtttcagcctgatctcgtaagcgatgttgtgatggaagaaaccatagatgtcgaaaccgtcggaacgatcgggtgtggccgtcatcccggccaggaaactgggttcgaaatagtccacgatggcctggtatgtgggggcaccgatgtgatggacctcgtcgatcatgatgtagtcgaaacggtccctcgggatccttctgtagacctccggattggacatggtctgcaccgtggcgaatatgtagtcttcatccggacacccttgggaactgtcatacttcgccatggaggccccggaaccgaggaccctcctgaaactctcgaatgatttgttaaggatcggcctcctatgtaccagatataggaaccttcccccgtacgccttggcgtcgaaagcggacaggtatgtttttccgcttccggtggcggagatgaccagtgcacgggtgcctcccctgttgcgtatctcctggagaccgcgaagggcctcttcctgcatcttgttgggtcttatcccgttgttttgggcagggatgtcgtggaatgcgggtgtggagaaccgatacctgtcgtagatctcctcatacacctccatccactggtcggttatcggcatcgcatgctcgaacaccttttcgaaactgtcgatgatgtccttgaccaactcgccggtggacagggagttgaatctgacgttccattccccgttggaacacaaggcgttgttcgtaaggttgctgctgcctatgatgacgtcgtaggtacctttccgggagaagatgtagcatttggaatgcatcttcatctgctcctcggtcacgatctttatctcgatgttgccaagggattggatcttccttatggccttcggttctgtgaaattctgatactgggacgtcagtatcttcccggggatgccgtggtcgcggagatacttgaattcctccagaagggcgttcacaccgtcgtatgtgatgaatgcgacggagaacatgaaggagtcgcagttcctcatctcctccctcatggtggttatgaccttctccccacgggacgggtcgttggatatgaactgggggatacggtctgcattggcagggactgtgtagtccaagaatcccctttcaagacccagcatcaaagattcgtcgttcatcgatacaccgttccaatggccctggacgatcgacaaaggcgatcatcaaactatctccgtgattccggtcatataagatatggtttttgatcaagatcctctgaaaagcggatccttcggtcgaacgggaccgccccatacggatggatcgatacgcatcctaaggtgtgacgattacgccgaccatgtgacagaacaggacgacatatacgatatgactgtgcggaccatcacaggtataccaacagcccatcgtacttgctgttgtattccgctatgagctgcgtccgctccgtgaacttggccatgacccctaggcccctcagcaccatgcggtggttggtggctattacattggcatacccgttgggtcttatgaccaggaacttcccgctcaggttgatgtggacgaagtacttcccgtctgcgaacgaatcgctgtagagggtctccgcatccaacctctccacccgatatttctggcttacaggctcagtgcgggggatggtatcggtatggcgtatctcgggtatcccgggcacacaggtcctggaccttcctccgatgatgggagggggcgtctccgtcagagggcggtcggagaccgcggtacacaacgacacctggagcccgctcccggagaccggcaggtcctccgacgaaagttcaatctcgtcctcggatacgggggtctcgcgggactccatgacgatcttgctctgttccacctgcttactgaggtcggccacctggtccctgagattcctgatgatctcgctgttcctcgcattggcctcctccgtcgccttggagtacatctcctccctgtacttctcctcgaagatcttcacatatgccctcttgttgatctcccagagggcggccgtcacctcactgcggagcctgtcgtcgaactccatggctgttgcggcggtgatcttcttcaaaggggtcgcataatagacggtcccgctctcctccaccgaacatagccagacgtcgtctatcccgaccgtcccctcatacatcctgttgatgaacactatgcgaccgtccagacgggacacgatgttcaccttcttcatatcgagggcgaaacggaggacgcggagcttcctggtctgtctttccagatcttcctgggtgaagcccccttctgtgaatgcgcccccatactccctctggaggtccagaaggtccatcttgcgctcactcatagggcccttcccccgcatcggacggattggacagtatgaggaacgggatgtcgtccagaaggtagtagatgtccgccaccctcttgcactcctcgttgtagacgtcctcgaaggcggccacctccaccctcttgccggcggcctgcaccttctgcatcgcaggtacgaaatccctgtccccgctgatcacgatggcgacgtcgaaatggttgagaagggcatgttccagcatctcgcaggcaagggagacgtcgacctccttctggaccaccttcccgtcgcggatggcgagggactccctcgcaatgaccctgaaaccctgctcgcggaacttgttgtgcatgcggaccgtggcatcccctccgccggacgacggcaacttcccgtcgaatatgtatgcgccgatgaggtctctcgtccctacgaggatctgggtgagcctgaagaggtccatccccaaatattcctcgaagaatctgcaaccttcgtagatattgcgatagtcgatgaataccatgacgcgattgtaggggtgttcggcgaagagggtcattctaaccacgtattgatgatacaggtatactcaacatctttattatccctgtttccgatagatatcccggatctgcatgatgaggggtatcggaattcattccaacggcgatgtgcccgagctcaccggcctcagcgaggaggagaaaaaggccctcgctgctgcaagcggaggatcgtccgtcaaagcgacggaagggcaggagaccgtctccagatacaagttcgaccagatgaagaaagatctggatgagaaactcagaaaatcggaagataagaacaaaaagacctccgacgagctgaaaaaagtccgcgaggaaagggatgcggccctcagacgtgcagagaaggccgaaaaggaatccgagaccaaggatgagaggatctccggcctggagaagaccgtcggagaaatggatggtaggatcaaaggattcgagaagagggaaaagagccgggagtccgtcacccctgctaaggagacccccagggaggcatccttggcaaacgacctgagaacggcacaggacaggatctccgaattggagaccgagttggactacatggattacatcatcggcgagatggcggacatcatgtcggatccgccggagaaagaaccttcgcaggagcatgccgccacgtcctccgaggcaccggaaccggtggggaagatcgtaagaagcggcccctccgagctcacatcggacctcttcgtgcttccgcggtacaaggtcaccctggccagaagcgggagctacatctccttcgaacccgacgtcgacggacacggcatatgcgtggacggcaccatatcccttccggcactcgaaggactcataggatacagaggccgtgaggaatactccgtgttcagggacgggaggagactcgtcgcccatctgatatgaatcggcacatcccggtcagagcatctcggacactataagcggctccttcccgaagaacgccaccccgtacagcacggtagggccgttcagaccgcgtgcataatccttctccctgatgtgccttatggcccctgccgcatccctctcacgggaacctgcgtcgtccgacctcttgatctccattacaacgttgcatccgggccccgacatcttttccatcctgatgtcgtagtatcccttcccggactccctgtccgccgttacagaatatcttccggacatcatcatcaggacccctgctatgaaagcctgatacgaatgttcgttatccaatacacgggagctgagggtatcggccatcagggcatacagagacctctccatgacctggacgtcctgggagaggatcgccttggaaaaggctctgagactttcgaacgcatcatcgtcatggaaaacgaaacggaacgtcatctgagagaagaccgaatacaattccttgttgggtatggaaagtctgtatcctccctcccccgggatcgccttgaggtacccggacatagccataagggaatatatgctgccgagattgccgcagaggtcgtcgaacgtcagggatgcggaaataccgtggatgacgctccctccggaacccagggtcccgaggtccttgaggacgccgtcgtccgcatggagaagaaggtcttctaaaatgtcgttcccgctggtgttggcccagtacggtgccggctcgaaaccctccgacacatagttgaggatgctccaaggattatagatgtccgcatttccgaaacgatagccgtcgtaccactccttggcctccccgaacttctccggatgaccgtaatcggaacatatcttctgcacttcgctgtcggtgaaaccgaacatctcatcgaaccgcttgctcaaaatattatcaacatagagattgttcagaccgctgaatatgttctccttggtgatctgcatcactcccgtgacaatacccatctgaagggaatcgtttcccttgaaaagtgaggacattacccctttcaaaaaagctattatctcacggcgaagtccgatgtcagatactgtgttgacagcagaatcgtactcatccatgaggactatcactttggttccgtggtgtttttccagcatcgaacatagttttttaaaagcatttttagaatcggattcgtccttgtccccggcgtaatactttgtaaacagttgtttgctctcctcgcttaacttcaaagattccctgaggtaagtgaaatcatcaaaaacatcgaacaatatcgaattgaaatccttcaaaaaaccgttgaaatccttgacgccgcaagattttaaatcgatggatattaccggaaatgcattcttataaacatcatattcgtgatgtttcgatatctcgagtccatcgaaccaatcgtttcctttatatttgatattgaaaaaagcatcaagcatgctcaggttaagggattttccgaaacgacgaggcctggtatataggaatactccacaatcattctgatcaagaatctgtccgataagcatactcttgtcaacgaaatatttgtccgttttacgaacggatttaaaatcctgtacacctatcggaaggggtttcataatctacgctaagcattcgattcatatattgtttatccggacgggaagttacttctaaaggatcggacggattgaaagatcccgagatacatcatgatccttcccgaagaacgccgatgcggcatcacggattattctggatgatgccctgcggcagttttcccatgcatggatgaagggagggcaccctgtttattaagtactgttaataacaacctaccccctaaataatccaaagccgtgtcattatatacacgcctgtggtccgctgtaaggacctcggaatacagggatacgatgcatagggccgctataggattgacattcaacgggggacccccacatccggggatttgacatgtctctgatcggcgacctatgcgacgataggaaatgggacctctttctggagaataagatagctggtaacacttgttcggaccgcgagaaggaggatttccgcaggttcgtgaaaaatcgcatgtatcgtaacatcacggagaagatacaggcaggggaatacagattctcaataccgagaaagaaaagtatcagcaaggcaggcacggacaagaggcgcatcgtctacagcttcacccgcaaggagaacatggtcctgaaaatgatggcgtatctgctccacagatacgaccgcatattcgcagacaatctgtactcctatcgtaaggacataggggtgaaacaggccatccgcaggattaccggagtagacggactggaaagaaaatattgctacaaggcggacatccacgactatttcaattccgtaaaactcgaaaaactgcttccgatcctggaagataccgtggatcggcagacctatgacgtcatatcgggaatccttacaaaccctcacgtcctatccgaaggcaggatcctcagagaggacagcaaggggatcatggccggcatccccatatccgcatttctggccgacctctacctcatggacatggacttccattttcaggacgagggggtgttctatgcgagatatgcggacgacatcctgatactggccgacttcgaggaggaactggaagagtacagggagtatgtctgcaaccacctggcatccaagggcctcagcatgaacccgaaaaaggaacacatatactccccgggagagaccatagaattcctagggttcggaatcgacggcggaaaggttgacttagcggatatcactgtgaagaagatcaaggcgaagatcagaagggcttcccgcagcatatcgcgttggggggacaggaccggcgcctctccgaaagccagaatgacggtgatgatccaaaaattcgacaggatattcttcggagtggagtccggagaactgtcgtggaagaaatggtacttccccatgatcaactcgatcgagggactggagacggtggatcgctacctgcaggaacgtataagatgggtagggaccggtcacaacagaaagaagaactatgaagacatcccctacgaactcatgagcgcgctgggatacgtcccgttggtccacgaatactatctctacagaaaagaattaaaaggaatggataatggggacggcaacagggaagatgtgtaaacgtccgcaatgggcaaagcatgtcgcagatacggccgtgcggatggccgcggcgtgtatggtctgatcttcgaagctggtatcgcaggaaccttcgattcctgagataccatcttaagtggttcttccctgtggccccttcaacatcatgtcacagcatgtacagtttgatgctgtcgtaaagttccccggtcttctcgtcgcatataagtctgctgtcggccagacctacatccatgtggtatgcggtcgtggtctcgcagccatagtataccttgcctccgccgatgtcggtatacagtatcctgtcgcctgcggatgacgactccggagcctcatacccttcgatacacaccgcggacatggcatgtccggggatgtcgtatacccctgcggcatatccggccgccgcgaacaacgtcgtgcataataccgaggtgtcctcgcagtcaccgcacccggaatatatcgtctccatggggaatgtccagtaatccacgttatccgagaatgtcacatactgttcgtgatcgtattcgtaataccagtttatctgcacgaaaccgaggatgaaatccgcatacgcctgtcctgtgacggatgcccccgtgccgtataccctcagatattccgctctaagcttaccttccaggtctgtgatgacggaattggaacgacagaagaacgtctcctcgtacccggccgcggccgaattcctgtagaccgtctttccgtccgacacatatcctacaacgtagtcctcgttctgcgtatgatatctggaatagacgccgtacgggaactccgtctcgaaggagaacctctgcccctcgtacacccatgcataggtcctcttgaacagattggtcccatccatggaaccatcgttggagttataggtgaacgtccccgtcacccaatatccggtaccgccgttaggggtcagatagaatgacacggaataggagtggccgaccgaaagaccgcctaccgtaagggtcagatcgcccacgtagtcttttgccatcagactgtagtagtattggccttctgccaccgttctgccgatagtggtgtccttgacattcatagtcacacgcgataaatccttggatgcgttccccgtacacgattccgacttggagagcatctcctcggtgtatccgctcagggttatgatcgccgtccccccgtaattgaaggccaaggacaggacccctttctcgaaaccgtcccccttcagaagagcgtagtccttctcggaagtgtatgtgttgtagaccttcagttcgttctccgccggatccgccgtgacgtggatgtccgcggaacggacatattccccggaggtcacggatacgaccgcatccccttctgcgacgcctgttatggtggcggcgttcctgcattccggatccgcctccaccgtgacgatgtccggatcgctgctgctccacaccatcccttcgatgaccgaggtgtaggccatgcctgtgatgatgtacttctcctgccctatgccgactgtggtctctgtggtggtcagctcgaaagaaaggtctacgtcgtcatcttccatggaaatgatgccgtatacgacggtaagggcgacgatggcgatgaccgcgacgatggcgatgcctatgagtccttccaaactgccttttctgtcggatatcgatttcatatgcctccaccctcggcggacgaccggtccgatcactctgcacaatatatgcgcgggcatggttaaacacgttgccgcagaaataggacaatacattacacatatttaaaatgccaaacaattatcgaacattctgaatatgaaaactatattttcatcatatggttgataatttatgagtggatggatccgtacccgtcgcgggaggcgagtccgaataatgaccgcggtctcccggaatatgggattgtctcgccttggggccgtcatctctccccgtatatctccgtcgcatgcgccccgtaatagtcctctatcctcctctgacggaggaaatcggtgaagacatccgaattccttatccatgtccgcttagggatgtccattatcgtacagacgtagtccaaggccttgtccagcgtatcgaagtgcaatgggacctgcctcaaagcctccctgacgttctcacggacgttccatacgccgacgggcatgacgtatccgggatgcgcctccctgcatatgacggcccctgcagtccttccctccctttccagaagttcgttcacggccatcctcgaggcataatagcatcctcctatgtgcgcatactcccagcggctcccgaagaactcgctgtcgtgtattatctcgatcctcctgcccatatggtcggaggcacagtcacccgccggtgctgcggatacggccggattccaggcggtgtcgggataccacgcctcgatgagttcgaacctccaggtggtcggcatcatgactatgcaccaacggttatccagctgctcccaccgatagaccctgaaatcgtctatggtaggatagaatctggtccttttgaggtagtccttgcctatgatgtcgtccacggccgtgatactccatctcgtagggacgaaacggcggttcttctcgatccccatggtcccgacggagaacgccttctggatctcggatatgagggtgccgctgttgtatgcctcgagtaccgccttggtggcgttgaggtccgtgtcatagaaattcttctccagattgcgctcccacttcccgttggatttgcggaacccttccatcctggccgaaggaccgaatggttggacctcgtcgtcgaggactatcctcccgcggggcctctccctgaaactcgcctccacgtccaccggcctctcggtaagggccaactcctggatgtcgccgacgatcttgccgtatctgcggaagtccttggcatctatggtgtacttccccctgaccagacggtatctcatgtccacgacctcgtctatggacttgcccatccatctctccggcgtatccatgatggacgtgtccccgaactccccggggaccagggggccgatgtcgaccttcggatatccgtagcggcctacgaacacagccggaggactgcttccagcgagatccctcatgtccgtgaggggcttcgacctctgacgggaatagaactttatcataagcgggcagcggggtttgccgcacagcagatgtgcccctttgcagacgacacagaggccggacttgacgaccgtgccgccctctttctgcatctcttcgaagaacgccgcccccataggcctgacatatacggaacagcgataaaaaccgtacttaaccggagaatgttacaatataagcgcagaccgacctggagttaaccaagtgcaaggggatcgatccacgctatggttcggtaaattccgtttgagtataagaaataatcccaaaacatgttgatttttcataaaaatcaacgaaatcagagacaatttaaactgttatacttatataacatactcaaaaattagaagctaccacgttaggaagatgttctctgcagatgctcgatgcggagcttccttccgtagacgttggagaattcgtccttgatgctcttgagtttccacagctgcatgctgatatccttggaggcgatcagcctcagcgagaccgtcccgtcgaatatcgcgatctcgatacggtccacggaagaatccctcccgcggtccaatatgtcggcgatcttgaggatgagcgcacacctccgtatagcggcggtctcgttcccgtcgaaatccaggaaatacttcgacgacggccccgggatcgaattatgatggaaacgggccatgagggccatggcctgcaactcgtcatcgtcgaatccggcgagatacgaattcctgatgatcgtataggaatggacattgtgcttctcatagctgatgaattcgccgacatcgtgcagttccgcggcataccccaggagttccctccaatgagggccggtccccatcacccccgccttgacgagggcatcatagatggagagggcataacgcatgacggcatcggaatgcttcctgtcgcatccgcagcgggcggccaacgtacgcacggaggaaccgcggacatcgaaatccggatgcccgtgttcgaggaggaagtccgtcctcataccctcacggagaccgttcctgctgacctccatgacctctataccgagcaggtacatcagttcctccacgaccgctccgcctccgacgattatgtcggcacggttcgcactcatcttggggaacttgagtctgccctccacatccgtggcgcacatgtccctcatgagggattcgagttccgaataggtgaggtacgaaggatccccgtcgcctctgcgggcggcgcatatctcggccaaagcgacgatggtcccggaggatccgacgaccttttcgaatccgagttcgcggatcttccctacgctcctgtaggacgccgtatccaccatcctgcggaggacgtcgtactgcctgaatgtgaccttgcccttctggtcgatcccggagccgtaggcgagacggatggctccgaggctgagactgtccagataaaggtcgtccctcccctcggcaagggcgatctcggtgcttccgcccccgacgtctatgcacagcgtcctgacgggtgcatcgggccccaggacgcccaggcggatgagcctagcctcctccataccggggattatgcggaggtccacgccgcaccccttgacggcctgcacgaggtccgcacggttggatgcctccctggcggccgcggtggccatggccaccacctgctccgcaccgaaacccttggccacctccgcgaacttggatatgactatcctcgccttgtcgatggtctcctcgtctatgacgccgcgggaatagaggctctgtccgatacgtaccgactccttgtcggagtatacggaggtcccgagggacccctcgtagaaacggaccaccagcatgtggaccgagttggtccccacatcgatgaaccctatggtcttatccatgccacacgcctttgttctcgaggaaccattcctgagatctcagcttcttctccccgccggcgcgcttgcggagaacgtacgtaccgtcgctcttcagctcgcgtgccttgacattgtcgttcagagttatgttgagtatatcgtcccttatgcggaccatcatctccttgtccaggacggggaagaggatctccaccctcgccaagaggttcctgggcatcatgtcggacgaccccatgtacatcttggggtccccgtcgttgtggaaatagtatatcctctcgtgctcgaggaagcggtccacgatgctggtgaccgtgatgttgtccgatatcccctttataccgggcctcaggcagcagaggcctctgatgttgaggtcgatcttcacaccggccatgctcgccttgtagagctccacgatgatgtcgctgtctatgagaccgttggccttcatcgctatgtaggccttgcctccggccttcttcacctccgcctcgttgcggatcatctcgataagggtgctcttgagggtaaggggggcgaccagcaggtgcttgtatttcctgggaccgaagtacccggtaagggcgttgaacagctcccccacatcctcccctatatcctggttggcggtaaggaaggagatgtccgcatactgcttcgccgtattggcgttgtagttcccggacgacatgtgcgtgtatctgaccagatggtccttctccagcctgacgacctgcaggagtttggaatggaccttgaggttcacaggcccgtagaccacgtggacaccgatcttctccagctcacgggcgagggcgatgttgttgacctcgtcgaacttggccctgagctccatgaggacggataccgccttccctttctccttggccctcatcagctgcctgatgatctcggagttcttcccgagcctgtagaggcagatcttgatcgactgcacgttgggatcgtcggccgactccctgaggaaacggatgacggtgtcgaaggtctcgtaggggtggaacaggatccagtccttctgtctgatcacgtcgaacatgctcaccgactcggagatctcctgcgggaccgcggggacgaacgacttgtacttcagggagggcatgtttatgccgtagatctcccagaggtcggtaagcatcatacccttgtcggaagcgcgtgtgacctgctggtccctgagcttgaggttcttggcgaacacggatacgaggtcggagggcatggagtcctccaccaccatcctgacggggaatcccgcatccctcgagtcgagggcgatctccacggcggacatgaggtcgacggcctcgtcgatggtcaccttcacgtcggcgttacgggtgatcctgaacttatagcatcccaggacctccaatccggggaagagggccccgatgttgtccttgaggatgttctccagcaggacgaactgtttcatctgtccctccgaggggaccttgacgaacctcgggaggatgccgacggggaccttcacacgggcatagaggacctcgccgtcctcgcgcctgagtttgaccgccacgttgagcgagttgttggatatgaacgggaagggatgggagatatccagggcgaggggggtcagcaatggatgcagcctctcctggtagtagtcgtccacccacatcttctgcttcgggtcgagggcggataccgagaggatgcttatgccgttggcggccagaggctcctccagatgggcccagcagtcctcgtacccgtcgatcagctccctgaccttgtcgttgaggacgcttatgagctccccttcgtcgtcgtaggcgtcggggccgatgttcaccagacggtccacctccgcacccaggaggccgggcatacggatcatgaagaactcgtccatgttaccgtagcagatggccaggaacttcaccctctccagtaccgggttcgtgtcgtccatggcctcttcgagacagcgtttgttgaaaccgagccacgagatctccctgtttatgtacagggagcggtcgtagaggtctatctccttcgtcttggtcgtcatcctatctccttcccgtttccttatcaggacttgctccggtcccgctcaggcgttccttatcttcacggagttggcgtgcgcgtgcagaccctccacgccggcgagcgtgttgatggtcggggcgagggcggccagaccctccttggtcagcatctgcacggtggaggtcttcctgaacatggagacggttagcccggagcacatggtggcgtatcccgacgtggggagcacgtggttggtcccggaggcataatcccctgcggctatgggggtgtaggggccgacgaagatggaaccggcattcctgatcttggacaggacgtccatggggtccttcacctctatgcagaggtgctcgggagcgaccccgttcattatctctatggcgagctccatgtccttggccacgatgtatccggagttcttcatcgactgggcgatgatgtccctcctgggctcgtccttcagctgtatcatcatctgctcccacaccttgtcgggcagggaggggtcgtccgtgacgaggacgaaggcggatgaggggccgtgctccccctgggccacgagatcggcggcgacgaactcggggaccgcggaggaatcggcgaggaccgcggcctccgaaggaccggcggggaagtcgatcccgacgatgtcctgcaggagtatcttcgcctcggtgacgaacctgttgccggggccgacgatcttctggaccttctcgatgctctcggtacccagggccatcgcggcgatggcctgcgcacctcccaccctgtagatctcgtcgcatccggcgatgtcgagggccacgagcacggcggggttgatctgtccgggcgtgcagcagatgacctcgtccacccctgcggtcttggcggccaccaccgtcatgagtgcggtactgggataggatgcgagtcctccggggatgtagcatccgaccctgttcagcggagtgctcttgacaccgagggttatgccgggctccacctcggtggtccacatgtcgggcggaagctgcatcctgtggaacctctggatgttgaatgcggcgttctcgagttcgtcgacgacctcctggtccacctcttcgtaggcggcctcgatctcctcgcgggatacggcgaatctctcgacgtccactttgtcgaatttcttggtcagctcgcggagggccttgtccccgtccttcctgacctgctctatgatgccctcgacggtctccttgacctcgtccgtcttggacatcctgttctggatccagtactcctcgtcgatctccttccacttctcgggctcgacgaactcctggtcatttgccgcttttgccataatggcgcctatgtcccccttattaaaataatattgcgcgcatgagacgccccgggttgtacgggaccgcgggacctgtacggagtatgacaaaaggtattattacaacgacccaatcagacggtcagaatgaaggtcataatcgtcggggccggaaacgtcggaatggcgtccgccgaggccgcgtcccgcaacaacgacatcctcatgatcgataaggaccccgtcagggcggaggcggccaagaacacgcttcccgtatcggtcctcaaagaggatggaagcaatccaaagatcctcaaggaggcgatcgagcgtaccaacgccgacgtcatcctaagttccgtaccggacgacgccatcaatcttttcatatgtgtcgcggcaaagaacatcaaacccggcatacgcaccatcgcctgcataaggaaccccgactacatgacggtggagatgaagagcgtcgacctcctggtctcccccgaaagcatcaccgcggagaagatcatcaagatggccaccctggagaacgccaccaccttcgacagactcagcatcaaaggcatgtgtgtggtcacattccgtatagagaacggacagaaggtcatcgggaagaccgtcatcgacatggacatacccgaaggatgcactatagtggccatatacaggggggaggagaccatcctcgacgtggcggccacggagctccgcaacaacgacaggctgtgcgtcatggggaccgacgagggcatacagaagttcaacgacgcgataggagtcaagaaggacatcagggagatcgtcatcctcggggcgggacaaagcgggatagagatcgggaagaccctctgcagcagccccgagaagtatttcgtcaagatgatcgacgacgaccttgccagatgcagggaggcgtcgaaagcgctcaaggaggccatcgtcgtcaacggacccatcgtggaccccctgttcctccgctccgaaagcgtcgacagggcggacgtcatcatctccgtgtcccccatggacgagcgcaacctcctggcctgtatgacggcactgaggttcgggacgaggaagatagtctcccgctactcgatggaggaatacgaggagatcttcaagtacgcaggcatagaatccgtcgtcggataccaccgcgtgatcgtcaatgagatctcccgtgccgccgtcatagccatagacgacaggtccaacggattcataagaatggaacggcccaacgacttcctgttcgggatagatgtgaagcccgggataccgatctgcggcatgatgctcggagacataaaagtgccagagggggtccgtcttaccgcggtcataagggacggaaaggtgttctaccccaatctgacgaccaagttccaggagggcgaccaggtcatggtctacacccatatggcggacccgatcaaactgtcggcgctcctcggaaaccagataccggagctgtgaagatgctttttcccaccctcagaagaaggatcgaacacctggagaggtgggaaagcgggaccataaaggtcctgggcatggtggaggtcctgctggccgtgatgctcatcgtcgtcgcgctctatgcggccttggtgggggatgacgcatcggtattcgcccggccagccccgttcgttctggctctgggactgttccagtatctgttcttctccaaccgcaagccgatggcaccatcgctggggatcctgctgatcgtcgagacctggctcatagcgttcttcatactcgccatccccttctacctgtccggattctctttcgccaactcgctcttcgaatccgtcagcgcattcaccaccaccggcgccaccatactgaccgacgtggacgccatagacggcagcctcctgatatggagggccgtgatgcagtgggcgggaggtataaccgtcgtcatcatcttcacggtcctcctgccgatgcttgggatgggaggtgccggattcggatccaacgagttctccggcgtcgattccagcggttacgccgtgaagatctccaatgcggcattcaacttcatgaggatatacatcctgatgacgaccgtggagatcctcatcctgatgatcctcggggtgaccccgttcgagtccgtgtgcatcgcgttctccaacatacccaccggcggtctgctccctgccaacgacagtatggcgagttacagcttcgcggtccagttcgtgaccttggtcttcatgttcctcggggccaccaactactatctcctcttccgcacgttcttcaccaaggaccacaaggccctcggaaagagctccgaattcaaatggatggtcaaatggttcgtggcatgctccctcgtcatcaccgcggtaatagtcgtcagcgacgagaccgcatacagcatagacaatctgggagcggtcggagacagtctctggcacgccacatactgcatagtgtccgcaggcacatcgtccggattcgccataaccgattacacgacatggcccgccctcggtctgatgatcctcctggtcgtggagttcgtcggaggtatgtcggggtccaccgccggaggtatcaagatccaccgtatgatggccctgagatcgtacatagtggccggtatggacaagatcatgcatccgagcatggtcacatccatgaggatagacaacaagaccctcgaatccaacgaggtatcgtccgccgtatcgactatcttccttttcatggtcggaatcgtagtggcactctgcgccctcatgttcctcgaaccccagctcgacgtacagaccgacttcggagtcgtcttcgccgccatcgcgaacgtcggggtcgggtccggtcagatcggaccgttcgacaactacgactccctcaaggacgccaccaagtacctcatgtgtctcctgatgtggctcggaaggatggaactggtccttgcgataatgatattcaccagagggttctgggaggatgtccgtctcaatgcaggattccgcgtaagggccatggagctcagacacatgtacaaggtgaacaagaagtacagatgaatccggatcccatctggcacatatcggatacgtgtaagataccgggttcggaacatctttcgggaatgatggagaagtgctacttcccttccaattgataaatgcagtgcattcccgggaatctaaggatgatgcgaagaaaaaacatcgtatgcaccgcgtttgccttaaaaatcggataaacatagccttagctatatccaatttataacggctcgaatgttgatattaatataaattcacatacgtatcgaatgataatagggtcccggacgataaaaatattactgcgtatccgtccggaacatgatggcccggcacatccgttcgcaggatgtgccaggcgttgttttccaagaaccctcactggttcctgcacatggccaggatcctgaacaccgcaggattcccgggctcgatctcgttgatcgcaccggccgccaccttggcctcccagtatgtacccttgtcgcagaaactgtagcctatcgtctccaatgcaccgagatgatgtccgtcctgctggagggctttcgaggagaatgctcctgaggcggtggagttgccgttgagccactggtagtacgccatgagcgcataaccgtcggcattcttggccttcatcctctctttcgcatatttggccgcatccttgacgcggtccgcaaggaccaaggcggagatgtagcacctgccggcacggtaggtgtcgcttcccttcaggatgtcctcggcctcggcgatggcctcgtcgtgtctgccgagggatcccaggacctgtaccttgagaacacggtcgatctcttccagattacccatcttcccgagggtctcgagggcctcctcgtccctgtcggtcccgtgcatgacggcggcacgggccctgaggacgcggtcgctgtcctccaattcgtcaaggatcgtcccggcgtccttgagacatccgagaccgatgagtccggtagccacctcgtacttcgatttctcttccgaaggaatgtgggacatcaggaccgacaatactccggggaagtccttatcgttcccgatcgtcctcaacatggagcagcacgtgaggaggatcatcggatcgtcctgattcttggaagcgaggtccatgatctgtatggcggcgatgtcgttcttctcgtcgcggatattctgtctgatggcctgcagggcctcattgttgtccattgccacgggttatgcctccttccattaataaaaatcgctggagtgcggcatatcgaaaaaaaaccggaggacatcggaacaccggcggcaaacaaatttatccggtccgccgattcatccgtgaaatggccggaacagacagatacggaggaatgaacctgtggaccctcgccaggtccctcagaagcaacgactgcccctgccccagatgcaacggcaggtcagccctggagacggaggtggtccgcgggaccgaggaaaggctcggattggaggtggtctgcgagaagtgcggaaggacctctttggacgccgaagtgcttcccagcggcgacatccgtctgacgctgaccggtaccgacgacgtctacgaaccgtccttcgatgtcgccgcggcacaggaggacgtcaggacctccgacgggacatccagactcctggcacaatccagactggcggccgccctcgcggacagcatgagggagagccagtccatggccgaggggataaaggtcatacgtgcggcgaagaaacttgccgacagatcaccggaaatgcgcgatctggcacttcgtcaggcctccgacaccgcatccgtatggatgaacaaggggaaccccgacgccgccatggacgtctacgacgaggtgaaggatctggcagagaactgcgagacctccgccgcatacatgatcatactgaaccgttccttcgcccagtattcgtccggagaggccaaggagcctctgaagaccgtcagggacaccgtcgacagactcgacaggctgaaggcggaaggaaaactccccgcaggcgacccgttcataagggcgcgtgcatacgaggcgctcggcgtcctgctttcatccaagaacgataagaaaggggccatgaacgccatgaagaaggccgtcgccgagacagaggccgtcctcgacggagaggtctccgacgaatcgatacgctggtacaacagatgttcccgcgaatatgcgttcgcatgctcggaggccgacatgaagaaaaggagcatggaggccctgaagaacgccgtcaagaccgccaagaagtacagcgacagataccccaacgcatatgccgaatccctcctcgagcgcgccatgttcgtcatcgactccgacatggccgtcccgccttatctgaggggagacatggacgaggccatctccatactcgggagacccgacgaggagggccgttacgaacccctgctgccgatagcgtacttctaccgctccaccaccggatccaacagcaaggacgaactggacggggaggatctggcgaaggcgtattccatcctcagggacggggtgatgacggggaaggtcccggacggggtgttctccaccgtgtccaactcgtatctggtgtatctcgagggcaccgacaggaccagggccgacgaggtcagagaagaactgcgcgacatgggcctgttcgtaagcatgggccaatccacggtgaaaagctcgtaaacgacgcccctgccgtcagatatctgtcaacaaatgagacaccgggtctgaaataagacacatatcccactaatatcaaatagattcagaccgatatcagggcaaggtgggcaatttgctttctaaaatcatcgtttacaggcttttcaacgagtacgactacgagatcgacctggataacaggaggatcacattcgtccactcccagaacggcctcggcaagtccacggtaatgaagctcgtatacaacatcctggagggaaacctcgaagaggtcaggacatgccccttcgagaggatggacctcatgttcgacaacgggacgaacatcatcgtcgagaacaacaaccaggaactgaacatcctgggacagaaggccgagctcgaggaggagatgagcgtagaggagcttcgcaacacgatgaaatgcatctacgtaggtccggagaggatgtacacgaccgatggggagggacacatcgtaccgtccctgatgatctacatgacggaactgtcccagaagatcggtcaggcgatgaaggactcggaacccaggaaggtcgaggacgacggaagggaactcagcgacgccgacatggacaagctcttccgcgacctggaggccaagatagacttcataaaacaggcagggttcggacccaccatacctgccggatacaggttcccgccaagcagatacgagatcagcgaataccgcgaagactacagggccctggcactctccctcgaggattacgtggacagatactacatgttcgcggagagcatcatcgtgttcaaggacatagtcaacacgatctacgtcaacaagacggtggtcatcaacgacagggggtatttcgaggcccgcatggacaagagcggtaccgtcatacccctgtccaaattctcctcgggcgagaaggagatcctcatcctgttctacatgatactgttcaagacggaacccggctctcttgtgataatagacgaaccggaggtctccctccacgtctcctggcagcagcagctgggcaagacgttcgacgacgtggcgagggtaaggaacctgcagatgatcgtggccacacattcgccctccatcatacacgatgactgggacatcgccgtcgaactgaaggctgctggaaatgattgacaatttatccgcaagcgatattgctaacgagatctcgatgatgaggtccgtcttcaaagggaccatcctcgtggtggaaggggtaaccgacagcagactctattccaaattcaccgacaaggaaggtgtcaggatactcatcgcccattcgaaggacaacgtacgccgttccgtgacggagtgccagacgagaagaggggattcgaaggtcgtcggcataacggacaaggatatagacggcctcatcggaaggaggaagtccccgcccctgttcgagaccgaccgcaacgacatcgaatccatgatgatgtgctccaaggccctggacgacgtcatgtcggaatatgcggatccggaaaagctgagaaacttcgaggagaaacacgggaagctgtcggacgccatcgcaagggccgccagtcccgtctgcgccctgatgtatatatcgtacagacgcgggatgaatctgagcttcaaagacctggaccactcccgcttcgtcaacagccacaccctggagaccgacatacccagaatggtctcggaggtatatgcgcaatcgatggctcagatgtatcccaaacagacgatagcggatcaggtcaggagcatgcttaaaagcctggatgacccgtgggatgcggtgaggggacatgatgcggtcagcatactggcacttgctctgaggaacaccttcggctcatacaacgccaaatacatccgtgacggggaactgagcggggcgctgcgcctcgcctatggtctggcctatttcaagaagaccgaactctacgccgtatcggagaactggtgcgggtccaaagatttggacctctgggtcattcgttgacctggaaatccttcttaacgatgccggatgccgtctccatgatggtctgcaccttacggtcgctctcgtcgaggatcttcttgcagtgatcacggaggaccacggccctttcatagacctccagactcttgtccaggtcaagctctccgctctccagctgtttgaccaggtcctccagcgtcttcatgctatcctcgaaactcatcttgtctacttcctcgctcattcgaactcctccttatccttgatctcggcctcggcctttccgtcgcgcatcctgactgttatgacagacccggcatgcagacctttgaccgaagtgaccgcccttccgtcaggaccggccacgaaactgtaacctctctcgaggacgctgtagggactcaacgcatccagacgtgcggacgtcctttcgagatatgccctcttcgtccccatcatagtactgatggcgggacctatcctcgagaagaccgcttccgaggacatcttctttccagagaccacactcccgagggccggcaccagcctcgcatcggcggatgacagcctcctgtgcatctccatggtcttcttggacagggcgccggccatcctggacgacatatcgtccagcttcatcaggagcatgtcgaccctgtccctggccttctgcggggagagttttgagtcgactaccatgaaacgtcccctcatcctctccgtcaccgcggtaagggccttgttcatcctgaccgtgaaatcctccaactgtctgcggatctcccccttgtcacgcaccgctatctgtgcggccgccgtaggggtagcggcacgtacgtccgccacgaaatccgctattgtaaaatccgtctcgtggccgaccgatgagataaccggcaccttcgatgcagcgatagcccttgccacaggctcctcgttgaaaggccacaggtcctcgagggagcctcctccgcgtccgacgattatgacgtccaccccgaccctgttcagaagctctatccccgcgacgatggtcttccatgcgccatcgccctgtacctgtgcgggagccagaagtatgtccacggggtagaggcggcccgtggtggtgattatgtcgtggatgaccgcaccggtaggggatgtcacaaccccgatggtcttcggatactgggggatcttcctcttacggtcctgcctgaacagaccctcgccgtcgagtttctttttgagggcctcgtacttcagatagagctcccctataccggaacgcttcatgctttcgactatgaactggtacgatcccctctcgacatacatgtcaagatgtccgtatgcctcgatcttcatcgagtcggacggttcgaaatcgattctcgcccgggaactgcggaacatgaccgcacgtatctcgctgccgggatccttgatcgtgaaataataatggcccgaagtgtacttcttgaggttggatatctcccccaggagccacaggtcgttcagctccttggtgttgttcaatacctccttcacacgggtgttcagctcggtgacggtcactctctcggacatggctggaagggcgataggttcgaaggataagacggtttcttaaccggaagatgttaatcacccggatatttgccatacgaatcggcatgaaggtccttccggacatcctataaattttaataaacaggtcctgcaatcacatatcatggacaaggagaccgcctcgagatacgtttccgaggatgccatggcattcatagacagcataaccgacatgctcaacgcaccctacttcgcgatgaacggcatggagccggtcagcatctccatggaaaaagtctccgtaaagatgaaggtgagaccccaggaccgcaacagcaacggattctggcacggaggggccatcttcggcgtgatggaccactgcttcgcaatactgaccaacatcgacggccatgcggtggcccagaacaactacatcaactactaccgtcccgggagaggcgacgagatcgtggcagaggcggtattcatcaacaagtcgaagtccctctactccgtcgaggtgagggcctacgacggcgacaagatggtcgccgcagaggtctgcaacgcattccggctcaaggaggtccatggatgacgagacgctgccccaactgcggcgccgttgtcccgaagggatccctcacctgtccccaatgttacacggaggtaccgagggacgacctcgaccagacggagcccgcatacggaggcaggaactacgaaagacccagagatgaatacgaaagacagctgaagaaaaggaagaagagtctcacggtggccctcatactcgctgtggtcccggcattcttcggcatactgggactgggtcagatctacgaggaccgcagggacagcaaaggatggaagttcctcgtcacgggactcgtgttcttcataatactggtaagcatgatagtcctcctgaacatgtccggcatactgggcgccataatgatggccgtccccctgatactcttcggcggactatacatctgcactgcgatagcatccgtggcggacgtctatctgggatccctcaggatattcggactcaggtgaccgtcaatatttaccgcgggagcggagttctatggcgatctgcgatgccatctgggcgagggccaatgcactcctgtccctccctacattggccggatcgttcttgaacatcctgcgataggccttgcggattatctccggctcctcctccgggtatttgcatctgaggctgatgggctggcgggagcttatggacggcattatatgggactcgaaggtgatgtcccagggatcgttggtaaggtacttggtgaattcctgacggatatcgtagctggtgacgaacttatccttgacgatggccctgaaatccttggcgacgagctccaacggggtcccattatagagctgtgcgacctccagaccctgtttctccgcatagtccaacttaggcttgccgacgtatttcggctccacctgtatgtaggcatcgtagacggattcgaagtcgccggcatccaagtcgacggcgcatacgcctatcgacaggatctcgtcatatgggaacccttcggaaccgtcgctgatggtctccaccacatagatcttgtcgcccatgtccgcccccacgacgctcctgttttttaatccttgcaaggaaaccttacttcgaaagcatcgaggagaccctcgggtcttcggaccttatcttcagagaatgatacatctgggtctccgaatccccggccgcgagggccacgagctccgtcagatgtatgacgggcttccccccggggacggcatcgtagaacaccatgcagttgggacatccggcgacgatcgcatcggcgtcggcgcactcctcctgcctctccttcatgagggcgtccttgacgccggggatgttcttcccgcagcacccgtacctgttcccgacgggttccgccccggtggcccgtaccacggcctcgaagtccttcatgaagcgctctgcactgcatccgggctcgagcgcgaccttcagccccttcagtccgggaagcttccttatcctttccaagtaacgtgccagtatggtggagacgtggggggcgtacacacctccgcgggcgaactcgttgcagcatccggcacagatggtgacggcctcacggccctgcatcctgttgcgcatcctgtacttcacgctgttcctctccacatcggtcatggaacgcagaggtatcggatacatgcagcatttgttatcggagagttcctttatccccactccgacggcctggaacgccctcgccgtcgcatatttcagatagggcagtctcccgttgactatgcatccgggaagaaggtacatgtccttgccctcgggtatctccggaagaccttccttccaggacgggtctgcgggaggtattacatacccgtatttcacaaaggcctccggtacagggaggcccagagcctccgccttcatgtgcagcatgaccgtcttcggatcggtggcgggacagacctcgctgcacttcccgcaccctatgcaggccttcacgttcccgtcccagccgtgcatcacgtaatatgggtcgcaccccccgttcgcataggacggacaggccttgagacacctcttgcaccctatacaggatatcatgaggtcctccaccagtttggcgttcgtctcgttcatgtcaatcatccctcccggacatgtcccagtagaggacacctatcagcggatcggaggagtcctgtatgtacccgtcttcggagatgccgtccagatagcccctgatctcttcctcctgggaaccgtcgaggtccgtgaatccgcgggcaccgccgacgtacgtactgtacgcctcctccatagatatcctgcgggaacggtgtttccggatatattctatacgggggagcagccccatcttccagaggatgtcctgggaatagagcagtttgtccgactccgtcttggaaccgtccttcccgactatcctgtagatcctgtcccagatcggattctcgcggctgacgtatccggcgaggaaacacatcccgcgggagaccgtcagcatcttggcgaacgtcccggcggagcatatggccggcgtcatatgtgctatggtgagaccgtatcttccgagtctcccggtgtccgcgacagaccagtccatggcgcggaactccgcgttcgtgatacccgatgcctccgccttcctggaggcggcctccgtcatggccggggatacgtccaccccggtgatggaacggaccctcttcgaaagtgccagcgaatatcttcccgtcccgcagccgatgtcgaggacgtccgtccacgacgggtccggatgtgcgatgcgtatgaccagggagacgaacgggtcgtcctctcccggtatggggccgtcgaaggtctgcacccgcccgtcccaatcgcttccgtccgacggatggaagccttcgggcctccacctcctctctatctctccggggtccatggggacgcctatgcaggacgcggatttaacggattgtcccgtctttcgctatcatctataaaaacgtacactccgatgacgtatcatgaccctcgagaacttcaggatcccgtcgacccgcggagatacagacctcaactgctgcagatgggtaccggaaggcaccgtgaaggccgtcctgcagatatcccacgggatgatagagcacataacaaggtactcggatttcgcgagattcctcaacgggaggaacatcgccgtctacggacacgaccatctgggtcatggggacaccactccgaacgacctcggtttcatcgccgaagaaggcggcgacgccatcctggtggacgacctcttcgaggtcacgaagaggatcgaatccgaatacccggacacgccgctcttcctactcggacacagcatggggtcgttcgtggcaagacgctacataacgaagtacggtgaccatttggatggggcgatattcgtcggcaccggcaaccagtcccccatatccgtgaagacggggctgttcatatccagatacctctgcagacacaagggggtccgctacgtgagtccgttcctcaacaagaccatactggagtccaacgacagacacttcgaagtcccagacatgaagaacaggtggatctcccgcgacccgaggaccgtcaggaagtacaacgaggacccactctgcaccttcagattcaccgccggaggtttcagggacctgctcaccatgataaagaggctggaggacggggaggatttcgacaggataccgaaggaccttcccgtcatattcctctcggggaaggacgacccgataggggacttcggcaagggcgtggagaaggcgagggacggtctccgcaaggcgggactcgacccggggatgaagctttacgagggcgcgagacacgaggtcctgaacgagaccaaccgtgaggaggtatacgacgacatcgcggaatgggtggaggaaaggatcccctgaccggcatacattgtatatccgagccccacatatccgtcggacatggcagacgagatgacggtgacggaactggaggagcgcatagaatcctgcaggaacaggatcagaagcgcggaggcggccatagcggagaggccggactccagccgtgcgcagaccctcaacatatccattcgtcccatacgcgccgaactggcggaactggaacaccgcctggaagaggccaggaagaaggagccggaggatccgcgcgaggaaaagataagaaaggaactcgagaagaaccaggcggaactggacgatatcgaggagaagctgcacggggagaccgacccgataaaggtcaacaacctgaccgtatccaaacgcttcctgcagatggaacgcaaccagctcctcataaggctgaccaatggcggacaggcggaggagacggaggacgaggaggtcgccggcctgaggaaggcaaacgaggccaagacccgcatcatagaggaccagaacgccaagatcgaggccctgaggaaagaactcgcatccgccaaggcggccctcgggaatccggaggacggggtgtcctgcgacgagacccgcgtgacggtgaccgcaggaagactcaactccattcagaacgaggcacgcagactcggggcggagaactacgaccttagatcggagatctccgaactgaagaaacaggcggacatgatgcaccgcaacatcggggaactcacctgccactgccgtgagagcgaagaccacgtgcgcgaactggaggaacgctgccgggccctgtccggacagcttgagacctccgttcgcaggctccgcgaagcagagaacgagataaagggactccgcgagtacatcgccggatccagatgaaccgcatcccctgtgcggggggacatccatcatggaacggacatgatgggcagctctgaagaaaagaagagccgatacactggaaaaccttcgatcaaggcagcggccggcatatgccggccgcatgtttcttaagaaggggtcggaagaccccggttttatcacagtcccgaatcgcttgccgtcgcgatcgggggactggcgatcacagatccgcccacctcgaacacaggcgttaggcctctcatctccctggacatgtctacgacaccgtatcctatgtcctgggccagggtgtagttcccgttactcttgtagaacttcgttccggaatggacgccgtcgacattcaccgtgtcggagatgtatcctgcaagagctgcgaaatggaatcccgtaccgatacctgcggcacggtcaccgcccttcgcgacgatgacggaatcaccggttatgaccacggtacaggtaggctgactggactggcagcgggtatcgtatccggaacctatccctgccccgaatataccgccgtttgccttgacccgggaattctcgatggtcacggatatcggctggtcgacataatcctcgctggcgatctcgttctgacggcttcctccgataccggcggatgcgttacctccgtttatcgaagtggattcggttccgaggacggatttcttgaccactatggtcgtgggatcgtggtacttggccccgataccggcggccttgctccctccgtcgacaccctttatcacggaatcggagatggttatgttcagacctcctattccgggagcgccttcggcttcgcttttgccgtagttcgcgtcacacaggaatttcgactgggcgaatccgccgcgggcatactcaacggtggaacctttgatggtcacggaggatccgtctccgccgataccgtatgcgcgggatccgtatccttcgacggtcaacgaggccatgtccgagacgatgatggtccccgtggtgctgaaggcgtttccgataccgctcccgtacttatccaggtatgacgaatcgtcagtgttgccgtatctctcggaaacagtggatatgtagacgctctccgctataccgctgtactcgtagcctccgtttccgacggccgtgagggcatctccggttatcgttatcttggaggtctccggaacggttatcccgttccctcctgccgcaccggtgagggagcatgtaccgacgatcttcagtacgatgtcggacccgtcctccaatgtcagggcggaacccgacgatgcggcgatgacgacattgtccaagaccagttttccgctcccggacacggtcatgccggaggtcgagttgacgctcttcaccgccacggatatcccttcgtcgagcacgacagtcccgttcggaacgcatccgatgtactcgaaggtctgggtcccggcgacggaattgtcgtccacggtaccgttcagatgccttcctaccacggatccgctgttgacgttcttgttcgcatatcccagctggtccgcgatgaccttgacgtccttcacggtgcatccggtgacgtcgccgtaggtcgccccgacgatgcctccgacgtcgcggtacgcctttacggtcacgccgacggcgctgcagtcacggacggagttgctgccctctcccacataaccggctatgcctccgaccttgtcaccgttgtcgtataccccggtgaaattgtcggggaccgcactgatggaggagtacttcacggtgcatccgacgatgttcccgtagacgtatccggcgataccgccggtgtatctgtttccggtgacgtcggcgttcaggacggtgacgttctcgatggtcccgtagttatagacggagccggcgacgacggctataccgttgtcggtggaatccctgccttccgcgggtccggaacgggcatctatcttcgccccgtcgacgaccaggtccttgacggtcccgttcagggcgccgaagagaccggacgcgcgatagaggttctcggtctgcgttatcttgaggttggatatggtgtgcccctgtccgtcgaacactcctttgaacttgttgccggaatcggcgttggtcccgatgggggtccactcctcgttctccaggtcaatgtctgcgaggagtttcacggtcttcccttcgcaggtgttgccgcagttcacctcggcggcgaacgcacggagctcggccgcgttggagatccccaccatatcggtggatgcgttgctctggaccgcctccgccctgagcgtcatgctgagggtggcggactgcgtcgcctccacgggcagctccacggacacggcgacggcctctatgaggcgctcgccgccgtcggtggccgcctgcagcgcccactcggtgctgaagtaccctgtaatggcggccccgccgaccgatatggtgaactcggaactgttctccccggagaccgtacagaccatcctgtagagggtggatacggtgctcaggttgtaaacactcatcaagaaatcgaaactgtcgccgggtgtcatgtcggacgcggtgacggttatgccgtccgctgcggaatatcctacggcggcggtaccgccgttggtgaatctgtcgctcacctccacacccagggagtagaggctgatttccccggcctccgccctgatgtccaccttgccggtggtcacgtcgaccgtcgcatgctcctcgtcggagaaccacgactgggtgacggacgtcacggccgtcaggcagagcgcggcgacgaccgccgccgcgacgatcatttttgtttctgctttcattgtcatcccttatgaaatcgatatgaaggccgcggaatgacggagaatgcgatgccggtcatgatgatgtgccgtcccgaccccctatccgagacctctttaggatcggatgcgggacctgaaaccgacatgacacggacatagcgtgcgctgatgtggattccgtggatatgccggtccgccttgcataaggcggaggaaactgtcccgtgcatctgcgatcctgctcctaggagcgggatccggactcggggcgcgatgcgccggaggtccgacggtcaggaaaaaatcctcaccccccccccggcccgattctcgggccggggaaggactcagacaagagtttcctgctccttacgattaaaatccgatgtcaggatatatatggattatgtcaaatccggatgacattccgcaaaatactgggattgcatggccctgacccgtgtcgggatctttccgggaaacgttcctcggcaataacatcctaccccttttatccgactgtggccatgccccatccgatagaacggcatatgccgtacaggagaccccgtatctcccaaacaaaggatgatcgcaatgaagaccgccaagaccatcgaggaattgtataaggaggccaaggagttcgacgtcgtcataaccgtggatgcggccttggccaccgcgctgaatgcgagggtggacgaaccgcgtctgaacggattcgcctacacggcgaaagaggtggcggccatgagggagggtttcaccctgggatgccccgtcatgtccgaccttgacatcgtccatgcgatcatgaaggacaccgacctggacttcaaatccatctacagcgagatcctcaacatccgtgacatcaggaaatacaccgaggatgtggaaaaatacctgcattccgcacgttcgaggaaggtatgggcgtcgtacaggctccttccgaccagggaacgcagcatggccgattacgaatatcggaacgatgccttcttcaaaggaaagaaagtggcgaccatcggtctcgatttcttcaacgacctcgacaaacacatgtattccgacagcatggagatcatagagccgttcaaggatggtgactacgagatcgacacggtctatgcgatcggcaacgacagacagatcgcggacagcatagtggacctcgtgaaggacatggacccgaccgacgtcgccatcgtcctcgattccgacagccctgtggcagatgcggtgagggccgccttgtacaggaacgagatccccttcaagaacaatctcagcgtcaaggacctgtcacaggtcagggatttcctacagttcatcaatctcgcccacggatacgggaccctccgcgtctccgacgtccgcgacctgttctccggatacggtgccagggacacctcctccggaaacgggctgaagacccagttcgacaactatctcctcagcaaggtcccgatagaggagcctcgcgacccggtcaccgtctctctcatagagacgatgagggatatcgggaagtacacctacggcgaggccctcgaacgcatcgtgggcgacaggaaatatctgaagcacctgcgtccgtccatcgagatcctcctgaaggatctggatatattcgacgagaagataacgcccggaaggactaacgagatcatctatgcggtcaacaacgtggaggacctccgccataacgagcagatccccgacgatgagaaacagggcgtgcttctggcggactgcaggaactccgcctatgtggacaggcccctcgtggtcttcgccggaatggacagcagctgggacatcaacacgtccgggaaggactatgtcgatccccaggcggaggcggagaagaacgccgaccgcatgggcatcctcctccagcagggagactgcagaatctatgcgattaagccgatgaccgacggaaaagcgacccagccctgccgccatataatcgacctgttcgtagacaggaaagggaaccccgtcaaaaagatcggagggttccgcgacatatgtcgggaatataggaaagggtcgtggtacgccgagacggaggtcgtgttcccgtccaaggggacagaaggcttcgaaagcagcgacgagtccgacaaaggattctccaagagcaaatacaacgcgttctcggactgtccgatcaaatacctctacgacgggatactgaaatcggaggacaacgaatacaccgtgttcggaaactgcctccatgatttcgcggagatgtacttctgctatccggatgtcgtgaagaagaaaggtgcggaatactatctgaacaagatggattcgctctattccggcctgtccagcgaatgcatggaggggctggaccgcagcagattcagcatattcatatccaatctgatgaagtacatcgaccagatacggccggcggacgtccccctggacatgatgatatcggataggaaggagaggttccgcaaccgcttcatggtggaagaaggtctggagaggtgctcgtcactgacggaatccgaaatggacgtccccgagcacatgtatgcgaaattcgatgcccgcgtggaaagcgatatattcgactacaagaccggaaaaccgaagtcgggggatgacatccttaaaggattcgaccgcggatcggataatttctgcgaattccagccactgatatatcttgccgtcctcagcaggaactcgggaatgaagagcgcatcattcaacctgctgttcgtcggagacaacgagatagaatccaccggggaaggctttgacataaaccgcaatgtgcgccgtgtcaaattgatgtcccagaaccacgacgacctcgtcttctccgacgattcccccgtaagaagggcttacgcctccaagaagggaaagaagatatcggaaaaatgggacgagatcgtctcatacctcaaggagatgtctgcctatgacggttggcaggattcgaaagaatgcatagaccatatttgcaaaataaccggatccacggaaagctctgtgaaaaccttcttgaagaagatgtccgacccctacgtgatagacgacgaaggtacggtatatgtgccagccgacagcatggaggatttcatagaacgcctcaacgaggattacagggaagcattgaggatcaggaccgtcccgttcagcacggtcaggcccggaaatctggattgtaagaaatgcagcttccgcaaagcatgcatggcgaccgagaggaagaccgtctcggagggagaggaatgataaaggacgagtcacaggaagcgataatcaattgtaccgagggcatggtcgtagtggacgcaggtcccggaacaggaaagacccagacggtggtaaagaggtgcctgaatctcatccgcagagacgatgtcggcaaggacgacatcgtgatgctgacctttaccagaaatgcggccgaagagatgagaggccgcctcatgaaaggaatatccggactctacttcagcgagggagcggataagatagacgatttcacattcaagcgcatgatgcgtacggccgaagggatgaaggtgcagaccttcgactcgtactgcctcggcatcgtgaaatcctccccgggacagataagcaagttcttccggttcgaaaaagagaccctgacccatagtgccagcatagtcgagaacgaatccctcaacaagacatatttcagaagattcctggaccgcttcctggcggaacacgcttcggagtatggggatctggcggctcttgcatacgaggatccggtatccctgtataaactcctggaacgtctcatggcccgcgggatcatacctctccggagcaacggggagacctcgggaataggaaggtggttcggagggaacgacgggaaggaccttctgggggataccgaaggcctccgtaaaatgatggaaggtttgcccctcgacagcaatgatgagaagatcctaaaggatgtactgtccttggaaggatacatcctgaagacgaaagacccagagatgttggatagggcggccttcgacagcagggaaacccttctcaggatgatccatgacgtctattacgaattcatacgcacaagtgtggccgatgaccgtctcacattcggcctcgccgcatcgttcgcattcatcatcctatacgaggacaaagagacgagggaaaggatccaatgcagatatcttatcgtagatgagttccaggacaccaacagcaaccagctgatgatcgccctgatggcactcaaacagccaaacctatgcgttgtcggggattggaaacaggggatatacggattcagattcgtcagcatagagaacatcacaagattcgaggagcgggtgaggtcgcttcgcgatcatctcaacgaagacaccgtacgcatatgctacgacataggtgatgtgaagagcctgccgctgaagaccagctaccgcagttcccaactcatcatagacaatgcgttccatgccctgagtgcaaaaggcagtagcaaggatgtagtaagcgacacgtccaacgtaaccctcatcaatgccgaagacagcacccccgaggacatgacctcgttcgagacggtccagtgcggatcgcgtctggacgaaccggaggaggtcgtccgcaggatcgagaactatgtgcacagcggcagatatacgatatacgaaaaagacccggccaccaggaagatatcgacaagaccggcccgttactcggacatcgcgatcctgtgcaggaccgcaaaagtctgtaagaacatcttcctggaatgcgagaaacacgggatccccgtcttcctccagggggacatggaggtcatgtccaccagggaggggaaactgctcctggcatggctgaggtacgtgaacgacgaccgcgacacgtgggggatagggccgatcctggccgatatggactatccgctgaacgagatccaatggatgatcgcatacgacaaagagaccggtaccgaccacataccggagaatgtcaaaagactgagggacgaactccgcaagaaaaggaggaggatcacagacctcatagccaccgtattcaagttctacggtctcgacaacgacaatacccagaccataatgtccgtgatatccaaggcacatcgttcgtcgctcatgaccatatccgatgtgatcaaaatgatagaatcggacatggatgacaatacgacttacaagatcgacgggatgcctgatgaaaatgccgtcatcatccagaccatgcataaatcgaagggtctcgaataccccatagtgatcattcccggggtcgacacgtatgcattccccaacaccagatccgatacggaatcgttcatgttcaacgatgtcatcggagtgagaagtaagaaggaggtcgtggaattcaacggagagaagatggtcaagacctcctggaagacctacctggccatcaaggcgcaggctaaggattacagcgaggagaagaggcttcttttcgtcgcgatatcgagggcgtcgcagtacgtcacaatgatcgccggggataaaccttcctgtttcttcacgcacttcgcgatgaggaatgaacagaaaacgagcattcccttggatatcgccctttccgatcatgtagaggaatcccggacccttgtcgaaaaaccgacccttcctgaaataaaaccccgcaggaagaacatcggagtccacagcatcatgcatgtggacgggggagggaccgaactggatgaatcggatgaggcgatcggacccaaaggaaagaactacgggatcaccgtccacaaatacgccgaacttctagtcagaggcatatccgtcgaccagaggatcctggaggaatatcccgaaattgtaaagaccggcaggataatcgaagacctccgcagagaacatgagctcgatgcggaagtggactgctcccttccgatcaacagactcaacgtcaccctgagaggggtcatcgatctgatagccctcggaaaggatactgtggagatccacgactggaagaacgacgtctccaaggataacgagaacgaatacagactgcagctcagcgtctatgcccatgtggccgagctcatatacaaacgcaaagccaaatgtttcatccagtggctggtgctcgatgagaccgaggaattcgacccgcttccgatggatatcatagaggaaagaacggagaagacattggaatcatacagaaaatgagaccgaatgccgaaaggatcccgtataataatcgatgattaatcatccatatagttatacgaaacgacatgagtgcagttgatataataataactttaaagacaataagttggaatacagggctatgcaaccgcagggactgtcctctgaagaggtgaaaaagaggaaagtttcaggaagatcgaacgataccgacgatcaatcgagtcggagttatctggatatcctgatcaagaatctagcgactccgttcaacctcatcctgttcatcctcggagccctgcttatagtcatgcccgagaagccggactacataaacgcaatggccgccacgggcgtcatcctcttcaacgtcctcatatccacgatacaggagatgaaggccaagaggcgtctcgacaagatcgcccttctcatgaggcctaaggtcaaggtcatgagggatggcaggatcatcgagatagaccgttccgacatcgtcatggacgatgcgatatacctcagtcccggggatcaggcacaggtggacggcataatcgtcgacgagaggatgctggagatggacgaatccctccttacaggggaatccagcaccaggaggaagcacgagggcgacacggtgtattccggatcgtactgcatatctggagaatgctggttcatcgtcaacaaggtcggggaggacaccttctcttccaagatgctcaggagtgcgaagaaattcgagaagaagaagactcctctccaggtcgagaccaacgcagtgacggagatgctgatgatcctcgcattcatcttcctggctttgctcgtggtactcaacatattcaggaacatagacgtcgtcgattcgctcagacaggccgtcatagtactcgacatagtacctatcgccctgttcctcctgatcaccctgacatacatgatagccgccgtccgcatggctgattccggggtcctcctgcagaactccagttcggtcgaatccatgagccacgtggacacggtctgcatggacaagaccgggaccatcaccaccaacaaccttgttttcaacgatatagactacatatccgcagaccgcggggaagtagacagacttgtgaaggaattcgtctcgaccaccggaagcaggaaccgtaccatcatcgccatcgaagacaagtacggtaagggagactatgaacttgatgacgaggttcagttctcttccgacaggaaattcagtgctgtccgcgtaaagaacggagattcctatgacaccatcatcatgggggcgtggcctttcctcaaagaccatgtaaaagaacaggacggcatagaagagaagctctcggcactgtcttccaaaggactgcgctcggtcgtcttcctgtccggaggctccgcacccctgcacagtggcgaggatatcgtcctccccgacctgacggtacttgccgtcatctccataatcgacgaggtcagacccgattgcaaggagatcctccaacagttctcggagaacgggatcgacatcaaggtcatatccggagacgatccggagacggtcgatgccatattcaagatcgcggacatccccggcgagaggaagataatctccggagaggaactctcggccatgtcccccgaggaatatgagaagacggtcgtggagacgaacatcttcggacgcatgcgcccggaacagaaggagaaagttatcgagaccctgaggaagaaagacaagtatgtcgccatggtgggggacgggataaacgatgtccgctccatcaagaaggcccaggtgggagtggccgtccaaagcggaagcggggccgcacgcagcgtcgccgacatggtcctggtgaacgacaacttcatggccctgccgaaggccatcatagaaggaaaacgtactgtcagcggcatgagggatatcctcaaactttatctgatgaggaatttcactctcgcattccttgtcctggtcctcctgctgttcctcaacaagactcctctgctgcccatacagaacaccgtctatgcattcctgacggtatccatagcggcgttcctcatgaccctgtgggccaaaccgtcggacaataaggacctggtgctccccagcgtcatgcgttatgtcatacccaccgccataacgaccacggtgcttgctttcgcggtatactgcgtgttctacaatgcagacttcgacatcgccgcggccatcgcgggcatggtcgaaaactccggatggagtgaggccgaattacgtgagaatctcggtataaacggcagcggatgggacgagatcgtcggaaggaacgccatgatcgcattcctgatactcgcaggcatatcccagctgttcatcctgttccccatatcgaagaggatgtccatcgacgggaagaggacctccgactggaagcctctggctctcggactgcttctgttcggggtcgtcatcgccctgtacaactaccccgacatatgcatcaagatcacgtatctgttccaattccccatggagttgtgggccatcataatcaccgccacggccatatggttcgtcgtcacgttgctcatcctcaagagtccgaaactcaacaggctctccgactggatagacagcctgataaggaaccatctgaaaaagaacttcgaaaaggagtccgccgaggcggcgaagagtttcctgaacgatcaggaggaatgacggccgcggagatccatcggatcgtattcgccgtcgtcgtgcatctttatcatcacataggatgcgaccttcgcatcggaaagggcacgatgatcctggaccccgtgaatccccgcagggtccttccctccgaggatcttctcataggcataatccaacttcgggtagcggtatttctcatactgggtctccagacggggatccggaagaggcagcctacagacattggccgccgagaacattatgtccctgcattccatgaaaagccctttgagattccacggttcgcggtaaaggaacttatccaggtcgtaacgcatgttatatgtggtaagccaccttcctttgacgatcttctcgacctgtttcttgacctcgaagaaaggcatggcacatgccaccttctccacggtgagatccgtgttctcgaatatccaggaatggaccatatcctccgaccattcatccacatcgtatcctacgacgctggaatagatctcgcggaccttccctgtggacagacatgcctcgcatatgcctatgtctaccacaagatcatgcttcttgtcccctgggaactcgggacctccgaccagtccggtcgtctccgtatcgaggaccaggatcttgtccggacagtcatccgcaaaatcgtcgagacagattatactcacgtaattctcaatgcggtcatggtatatctatgacacctgtcggcttgctagaagatgtggtccatactctctttccggacgcggatctgccacctgcgaaatgtgccagcatgtccatccctgcggatgcagagggatcggccatggcagatcccctgtcccataccgtccggtaccagcatgtccgccgcatccgtcccctcatatagacaatggtataatgtcatacaagccccatttgagggagggccctgtcggtcaggtgtccgaaaatccatatcgccctccgaacacgggagttagcactgcatgtaatatcaactcttaaaaaacatccacgtcccatgcttttacgtggtcaaaatgacacacaagatatgggataggaaaagactgttcagaatgaacaggaaaggagggatcgaaggtctccctctggagcttatgatcatcgtcatagtggcgacgctaggaacggcgatcctggtcggttggatgggcgacgtggaggaaccgaaatccatcgggaacgtaagcgccgagccgggatacctggacatcacgaacgccacttcggcggccacgttcaacctgacgatctccgtcaccgacaacgacggggccccgataaaagatgccgtcgtcatcatatccggatgcggactcacccacgtggtgaaggagaccgacagcaaaggggaggcgaaattcaccaacctgtcgctgagcctgaacggagccgaaaagggatacatcaacgtacatgtgtctgccaacggatacggcgataacgacagcctcagggtgaccgtggtcggatgatggacagaaggggcgttctcggactgccgatgagattggcggtcgccatggtcatcgtctccgtctgcgtcccttcgctggtctatgccaccgagaccttcaaggcggactcggacgtgtccgaagccgcctcggaggtcgaaaagatggtctccgcagcggattccgtgtattattccggatacgggagcacatgcacgatctacgtatcgatacccgcaggatgcgagatcatcatagggggcgaggaccaggatgcatacaccatgcgtgtgacctatgacggggatgtgaagaagaccgtctatacccaacgcccgatgatccagttcctgggcggaccggtcacggtggccggttccccggaactgaggttcgaatgcgtcagcgaggacggaatctacggggtgaaggtgacgtacgtatgatggagttcacgatgtcccgtgtcacgctgatggtgtgcgggttcatcctgatgacggcggtggccgtacctatgacccagatgatggaacacgaggccgatggcggcatgggtgaccatgccgtcgagaccgcggcggccatcgaccgcttctgggactccgatctggacgagatgtacatcagaggatgggacatactcccgtcccaggaatacgtcctgtccatggaaggacgcatactgaccatacgcgatgcaggcggaaacgaacacaccgcaggtctggcacatgcgtgtaacggcgtggagataagttacggcgatatgaaaaccatagtgcgtgacggcgacggcatcatctgccgccgaacgtctccgctatcttaccgagggcggttgcgaagcggtctatgtcggacctgttgttgtacaggtacacggacgcacgcacgctgccctccacctttctggatacgaagaacggatgggcacaatgcatgcccgacctcaccattatgccgtccacactgtcgagcatcatggcgacgtcgtgcgaacccaacccgtctatgttgaatgacagaacggcacagcgcttgtccggatcctcgggaccgacgaccgacaggcctttgacgtcctcgatgcgggagaacatgtacctcataaggtccgcatcgttcctggctatgttttccatgccgaccttctccagatattccacggcggccttggtgccgaagatccccgcatagttctgcaacccggcctcgaagcggtccggcacaggggcgaaatccacgctgtcgtatgtgaccagacccacagtccccccgccgtactgcagggcacggagcccctccagacactcctccttaccatagaggacacccatcccggtgggacccagcatcttatggatggacatggcgtagaagtccacgtccaggtcctccatgtccaccttcatgtggggagcggcctgggacccgtccaccaggaccttcgccccatggtcgtgggcgatctccgccacggcctttatgggcaccgtacatccggtgacgttactgcactggcacatgctcaccagtctgacattcccgtccatcgcctccttgaaggactcgatgtcgaagagtccgtcggggcccgaatgcgacatcctcatctctatgccggcggaatccctcagggtcagccacgggacgtagttggagttgtgctcggaatcggtggtgacgaccgcatcccctcttctcagaccgagtccgaaggcgaccgtgtttatcgcctcggtggtgttcttggtgaagacgaacgaaccgggcgaactcccattgaagaacctgcagagcgcctccctggtctcatccacgcggacggagacctcgttggcgagatggtggacgctcctccctccgcagactggatatttctcgtaatactccacgaccgcctcgatcacactgtccggacggagggtctggcatgcactgtcgaggtacacgcccttgtctgtcctcatcgtagggaagtcgttacggagctttgagaagtccatggtccgttcgtattccgccactcatataaatcattcatgcgcacgtgcggacgcacagataatataaaccgcgaccatatggcgagagcgatgacagaactgcgtaccgaagtcggaaagaccgtcctagaacttccggggatggtcgcatccggcatcatggatgagaccggtgcatcgatgatcaggatgctcgaggccggagcaggggccgtggtgacgaaatccatcggcctcgtccccaaacccgggcacgagaacccttgcttcaccgaggtcaagggaggtttcgtcaacgccatgggcctccccaaccccgggatagaacttttcagggaggagatggaggaggcggtcccccacgggaagatcgtcggatccatatacggggccgactccgcggagttcgcggaactggcgggaaggatggaggactacggcgcctgcgccgtggaactcaacctctcgtgcccccacgccaagggatacgggatggaggtcggtaccgaccccgccctcgtcaaggagatagtgtccgccgtaaaggatgccgtgagcatccccgtatgggccaagctcactcccaacacacacatactgaaccagatcggccaggccgtgcaggatgggggcggcgatgcgatcgtggccatcaacaccctgaaggccatggtcatatcccccgagttcgcaagaccgttcctcagcaacaggttcggcggcctctccggacctgcggtgagggccgtgggggtgaggaacatctacgacctctacgacgcggtatccatcccgctgatcggcgtcggaggcatcacggattggagggacgccgcccagtacataatggcgggcgcccgtgccttccaggtcggaagcgccatagccaaggacggacccgaggtcttcaggaagatcaacagggaactgaaggaattcatgacagactacggctacgacagcatagacagcatggtaggtgtggcacatgagtgatttcgtcaagatactcggcgtgaccgaggaggcctacgacacgaagaccttcgagttccagctggacgagaaggcgagtccgggacagttcatcatggtctgggccccgggcatgcaggagatacccatgtccctctccaagaccggcaggataaagtcgatcacggtgaaggccataggccccgatacaaagagactccacgagctgaccatcggggacatgctgagggtccgcggaccctacggacacgggtacgagatagaccccgagaagaagtacctgatcatcggaggaggggtgggcacggcgtccatactccctgcggtgaaagaatccggggcggacaccataatcgcggcccgttccgagagggacctcatcctcagggacagggcgatgaaatactccaggaacgtctggatagccacggacgacggcagcgccggattccacgggaatgcggtccagctcatgagggagaagtgcaaggagaacagttacgactgcgtcatcgcctgcgggcccgaggtcatgctctatttcacctacaaggcgtgcgaggaactggggctcgactgccagctctctctggagagacacatgaagtgcggcgccggggtctgcggatgctgcgtcatggacggacagagggtctgcaaggacggtccggtgttcagcaaggcccagatatccgtgatgaaggacttcggcaatgcgaagagggacgagtgcggacgcctcgtgaagttcaggtgattctagtgtccgcccccgatggatacataacggtatgtcacggaagcatgaccataaacgtgccccgcgactgtttctcgggggaggacgcacatctgaacaaggagaaggcggaatcgttcggtaagatgatcagggcccgctatccctggctcaccagcggctccctggacgtcctcttcaacaacgcccgtaaggagatgctccgtgtcctcgacgaggagtccggcggcaggaacgtcagcagacgcctggagaagaaaggggacctggaaggtgccataagacatctccgggaacacctggaggaggatccggaggaccccgatgcatggtatgcgctcggagagctcctttgcaaggcaggacgcacgaaggaagggtacgacgctttcgccgaagggcgcaaatatttctgaataagaccgtctgggtcatgcgtctccgaatacatcgttcagtgcgtcgacgatctccgggacggtcgccccccaaggcaccatgacgacgtttccgtccttttcatgaccctctttcacacgacagcatttcactatggttgtcaccccgtcgtccggcaccctgtcgcggggacagatgtttatgaacggtacatccctgtgatactcctccgagaatatcctcttcgaaagcctgcatccgaccagcgtcaagtcccttccttccacgtccggaacctggtcgaggaaacaataaggtctgtcggacgaagtcccggagacctcgcacgggaacatgacctccgccgtctccgcttccttggatatctccgagaggtctatgtcgacctcctccaccactatgggtttggagatataccctgatgcaagtgccagattcaccagataggacatcttggacggcctggggggaacacagtccactatacgcagcctcataggttccaggtccttgacgaatccgagatgggagaaaaggcccctcacgacgaccgccttgcccggatattcgcactgcagcctcgccagggcggggacgttgatcacatccatgtccggcctctccacatatacggtgtcatcggggagcgatattatctcatagtccgtgacgtcgcggaaaaggtcgccgtccgaggatttggacagcctcaccacggcgtactggtcgccatggttcaggaccacgtattcggcgcgtttgtaagccacccagccgtccatcatggatgctatgctctcttcggtgatgtcgcattccaccttgcgtacggatatgtccttgcagtgcacggacaccataatgccgtacacatatatctggatgaggaatcggccgtccgaagtacaacaaacgttttataccaatcacttttatcccgactacgctgtcggggtaacacagtggctatgtggcggactgcagatccgcatatgggggttcgattccctcccccgactctcaattctaacaaaattgtatccgtacgacattccgtccggacgtcctgacatgccttggtaaaatgtacaatgtcccagacattactgtcaatataaacaagacaaacccaacctttataaatgggctttaaatacgtcgttcttaggtgtataagttggccaatatgaagatcgagaacgtcgtcgcatccacgtctctcggacaggaaatcgaccttgacaagatcatggcgtccctggacggagctgaatacaatcccaaacagttcccggggcttgtctacaggctcaaggagcctaagaccgcaaccctgcttttcaggagcggaaagatcgtctgtaccggtggaaagagctacaccgaggtcgaggccgcgatcacacaggttgccaaggaccttgagaaggccgacatcaagatcaccatcaaacccaagatcgaggtccagaacatcgtcgcatcctccgatctcggacaggagatcaacctcaacacagtcgccatcaccctcggactcgagaaggtcgagtacgagcccgagcagttccccggactcgtctacaggctcgacgaccccaaggtcgtcgtccttctcttcggctccggaaagatggtctgcaccggcgccaagatccccgaggacgtcacccgtgcggtcgagaagatcgccgccgaactcagggatgcaagcctgatggcttgaaaaaagaattttccgcggacggatccgatccgtccgcatcacacttttccatcgacttccggatcatccgaaacgtgtcaggaactcgtcttccgatattatgggcttccccaattccttggccttcttgttcttggatgaggtggactccggatcattgttgatcaggaaatccgtagatcccgtcacggaaccggtgacctttccgccctgggactctatgtacgccttcagctcgttacggttggcataatgatgcacatcccccgttatgacgaaggtcagtccttcgcatctgctgccgatctccttcctctcgggaaccttcaccttgacctgcgtcatcagatccctgaacgaatccatattgcgttgatcgcggaaccatcctgcgaacgaggccgacttctcgggccctatcccgtctatgtccgataggacgctgtcgtctccagacgacacggcacgtatcaggtcatccagcgaatagacggccatcagccttttggccacctcgagaccgcacatcggtatgttgagggcgaagaggatgctctgaccgtcggtcacacgcgaccgctctatggaatccatgatgttctgcacggacttctccccgaatccgtccatctgggacatctcctccctatgatccgacaggcggaagaagtcggcatagctcctgatccaccccatgttgacgaacttggatatcgtctgctcggatatcccgtcgatgtccagcccctctttggatacgaaacgcgtgaacttcctgagttgtttcgcggcacagtccccgttggtgcaatagagcttgaggacaccggtatccgatcccctcacctccgccggggacccgcagaccgggcacctgtccggaacggacagctcgccgaccgtcctcctgaccctgatcaccttcgggatgatcttattggccttgatgacggatatctccgtccccggaccccctatacgcagacggccgcactcgcttacgttgcagagggacgccctcttgacggtcgtcccttccagctccacgggatcgaataccgcgaccggggttatggacgaggccgcacagctccactctatgtggtcgaggaccgtgtcggccgactcgtcctgccatttgaaagcgagaccggcacgggtggcatggtgtccggtcaccgacccggtcgatgcgagggcggaatcgtcatacgttatcacgaggccgtcgacaggatacggattcttgcgcccggtgaccttctccgtccatctgtctatggcgttcccgaccgtcccgatatccgggtccttcaggaactccctctccacagggtggaggccggccttctccaggagatccatcttctcgccccatgtcgggatgtcgtcatccgagtacacgagactgaacgggacccagtggatcctcctcctcttcacctcctccacatccttcagggacagggaaccggatgccaggttcctcgggttggcgaaatccccctccgattccatgcagaactgctcgaaatcggaatacgatatgaccgcctccccgcggatgaccagatggcccttcgccgggatcgtccgggggatgtcgtaaagaccgtccgccagatgggttatgttcgtacctatgtgcccgtcccctctggtgactatctttgtcagcctccctccgtcgtacgtcacgacaagggtgaggccgtccaacttccatgagatccagatcggatggccgtccgcccatttcaccaggtcctcgaccttcttcgtcttggccagggacagtgcggggaactcgtgcggctccttctgtcccgttatgtcgtcctcggacaccttggcggtagggctgtccgggaggacctcccccgtctcctcctccagccctttcagacggtcgaacatggcgtcccactcgtaatccgtcatgatctccgccctgccgttgtaataggcgtcggaggccgcgttgagcctgtctatcagctccctcatgagagccgtcttcccttccctgtcgtctcccatctcacttcgcctcgtaccagtccctgcctatgtggcagtcggtctccagctccaccttcaggtctgcggcggccgccatctcggtccgcaggatatcggccaccctgtcggcgtcggcctctttgcactctatgagtatctcgtcgtgtatctgcagaaccatcttggcatctgggacatcggctgacagacgtctcatgaccctgttcatggccatctttattatatcggcggcggtcccttggatgggactgttcatggcggccctctccccgaaggaacgctgtatgtagttggccgcattcaattccgggatcggtctccgcctgccgtagagggactcggcatagcccttttccttggccgacgatatcagaccgtcgaggaaatcctttatgcggggatacgtgcggaaatactggtcgatgaactcgtccgcctccttacgcgatatggaaagtccttggctcagaccgaaggagcttataccgtagactatgccgaagttcacggccttggcattccgcctcatctggtccgtgacctcctcgaaggggacgtggaatatctgggaggcggtggtgcggtggatgtccttcgactgcctgtacgcattgatgagattctcgtctccggacatatgtgccagtacacggagttctatctgcgagtagtccgcatccacgaagacgcatccctcggccggatggaagcatttgcgtatcctcctgcccatgtcgtccttcatgggtatattctggaggttggggtcgctgctggacaggcggccggtggcggttatcgtctgattgaaactggtgtgtatgcgtccgtccttgcgtatgtaatcggcgagcgcatcggcataggtggacttgagtttcgcacacgacctgtattccaggatgtgcgccacaatcggatggtcgggagccagcttctccaggacgtcttccgcggtggaatagccggtcttggtcctcttggccccctggatgcccatcttctcgaagaggacgatccccatctgcttagggctgttgatgttgaactcctgtccggcctcccggtatatctcggcggtaagatcggctatgcgtacacccaacttatctgagtattccttcagcttatccttgctggcacatatgccgttgctctccatggatgcgaggacgtaggtgaggggcatctcgacatcgcggaaaagcggaagcatgcctgcgtcctccagggacttcaggaggaggggggcggaacgcagggccacgtcggcctccgtaagagcgaaatcggatatggcggcggggtcggtgagcatgttgacggatttccccaggacctcctcgcgtgcagggatgctctcgttcaggaaaccggatgccaccgattcgcagttccagtcgctcttcagaggattgagcagatatgcggcgacgacgcagtccaccatgcggggactgacgtccgcacgcatccatctcagcagccccttggcatcgacggtggcggcggacgacgaacgggagaccgcttccgcgatatttctgcgaagcaggtcctcccccagcctgcgagggaggaataccgacctgtcggacgagcatatgcatgcaccgtagaacgccccgtcctggaatacggcggacaccccgatgtccttcccctcgaaataagggaggaacgaatccgggtccccggcctccgcggccctcttcctttcggatgggctccggacggctacgtccccgaaacgtcccagcatgctcttgaaccccagtctcttgaacgaatcgtaggcctccggcgtgtatatgttccccatacggaatgcctcctcgtcgaacgtcacgggggcgtccctgcggatggtgaccagctccttgctgagaagaagcgtgtcgtacccgtcacgcatggcggccgcggccttcgggggtttcagctcatccacatgggcatatgcgttctctatggtcccgaattgtgccagtatcttctgggcggtcttctcccccacccccgggagtcccgggacgttgtcggatgcgtcgcccatcagggccttcagctcgatgaacgcctgcggagtcacaccgtacgtctcctgcacgtcctcgggcgaataatgctcgtacaccgtctgcccgcccttggtcttggggatcacgacgaccgtggagtcggtgacggtctgcagaaggtcgcggtcgccggagaggatcctcacctcgtaaccggaagcctccgcctgcccggcgagggatccgaggacgtcgtcggcctcccatccctccgcggagaccaccggtatgcccatctggtccagaagggaccgcaggaccggtatctgttcggtgaactcggaaggggcgggcttacgggtccccttgtactccggatacagcttgtgcctgaaggtgggggaaggcagatcgaacgccaccgccagatggtcgggggactcctcctccacctccttgttcaatatggagaggaatccgtataccgcgttggtatgggtaccgtcgggggccgtcatgttggggggcatggcgtagaacgaacggaacagtatgctgaatccgtccaccagcaggaccttgcccttcaatctctcacacatccgcggagcatggagatctcacgggcgtatcctgccatgtcctcctggggggtctcgaggatgaacggcttgtccctgaacgcagggtggttgactatccgggagaacgcatccaaccctatactgccctgaccgatcttctcatggcggtccttatggctgcagaacgggttcttgctgtcgtttatatggacggccttgagcctgccgagacccacgacggagtcgaacctgtccaccaccgagtcgaggtcgttgactatgtcgtaccctgcgtcgtacacgtggcacgtatccaggcagacccccatcctctccttcagctccacacggtctatgatctccgccagctcctcgaacgacctccccacctcggtccccttgccggccatcgtctccaggaggaccgtcgtggtcatgtccttggcgagcattccgttgagggcgtccgatatcatctctatggcgacctccggaccctgcttcatgtggctcccggggtggaagttgtagtagttccccggggtgtactccatcctcgcaaggtcgtccgccatggtgttgcgggcgaactccctggcctcctccctgtccgagcacaggttgagggtgtacggggcatgggcgactatcttggcgaaaccgttcctctccatgaggtccatcagggcctttgcgtcggccgggtctatgggcttcgcactcccgccgcggggattgcgggtgaagaacgcgaaggtgtcccctccgatggagagggcctcctcacccatgtgcagataccccttggaattagacagatgacatcctatgtgcaacatgataacaaacctcgtgaacctctcatacgggaggccgcagggaccctctcctgacggagatgtccaacctcccgatcgcatcgtataccgcgtccgcttcggcacgcacggcaccgacgtccgcccccctgccttcaagtacgccgaggaccgattccgcggccttggcgtagtcgttcctgtacatggcgttgagttccttccacggaacatcgcggaacagttccgccgtcccccggtcgagagggaggatgcccctcagcatgaggacggctatcaccgggtatccgagggccccctgccaatatgtggaattgtcgttggacgagtacgtatccccgtcccacgtcaccgtgtatgccttggacttgtcggaggagaggacctgcgcggaggaatcccccatggagaccctgccgtccgacacggcgctgtaggcctcgtagatcttctccttcttcggcatcttgaaagccattgcgaccccatcgcattccaacggttaaaatattgcagagacgggcgcacggtaccgtgtcgtgcacataggaaattgtatacggccagacatccgatgccggaccctggcgactgatttatattggatagtgttggcacatccagagaggaacatgagggcatcgttgcgcagcgacaggtcgggtatctccggcatggcggccgcggtcatcacagcggtatcggtcatagtcatatgcatgtccgcatacatcctcttgggcgacgataagggggaggatgggaggtcggcggcgttcggcctttccaccacatcgatcaccatcgaggagggggagatcgtcacggtcacccccatatcctacatctatctcgattcggtggaatactcggtatacgacgacggcgtcgtatccatatcgagctccggcggatattgtgacgtgaccggcatgacccccggcaagacctccattaccgccgtatgcgaagggaggacggcctcgtgcgagatagaggtcgtggaacctaccgaccacttcatcatggcaccggaactccgggtctacgacatgaacagtccggacctggatctggcgatcctcgatgctaacggcttcttcggcagcgggggattcaggacaggggagctggcactgtctttcaacgccgcaggttatgcggtcgtgtcactggcgggatacaccaaggacaccctgacgatcgacccgggattcatcggaaactacctgaccgacttctacaggatagcattctccgtgaccggccccgacgggcagcatgtcgcagacagcacatacagcaggaatgtggcggactcgcttccggtcatggggccgtggagaacggcatcggacatcttcggatcctcatcgaacgattcctgtgccgaggtgggttttcccatagcctccttgggatacggcgaatacagcatctccgtcgacctcatccacaagatcccctcggggacatatatcgccaagaccataaccgggaccttcgaatatatggaaggcgacgggaccatggattccaacgagtatttcgtcagaccttatgcctggaaggacggttcggggatccacggtttcgagatcgaattcccgtattacgagtatctgatgtactatagcgagaacacggccaggatgaccacctacatatcgggcggcaccacatattacatgaacaaggatccggaggccgaaaaggaatatgtgcggaacatatgcgtcggcgggaccctgtgcaatctcctgtccgagaaactggaatccgcatacggcggctccgacctcggaaccccggaatatgcgcagttcatactgacgttcgtacagatatgctacggatacggggcggacaacatcctctattatggaggtgacggagcctattcctccaataccgactattgggcatatccggccgagaccgtatgggccgggaacggggactgcgaggacacgtccatactctgtgccatgcttttgaagaacgccggattcggagcaggggtgtatttcgtaccgggccatgcgatcgccgccgtggccctgacggattacgatacgtccaaggccttggacatatcccacttggggacctcggaatacgggataatggagacgcagaccggccccgtcacatactacgggtgcgagacgacgaccgaaagatcccgtgcgataggggtcatagacacctcggtggatgtgaacgggaccgtctacgactattgcgatacgtcggccgactggtgcaaactatacgttatctgaaattccaatccccggaatgtgccagactctgatcatgtaagatcgtccgattgaaaatagcgggaaaacgtacatttcattgttttaaaatttcgggaaaacgtacaaaacaaatgtttaaaatagcgggaaaacgtacattctattgttttggaacggcaggcataatgatggggacggtattcagacgcaaattatatgaccggatgctggagtggaaaaacagatccaacggtaaaagtgcactccttatagaaggtgcaagaagggtcggaaaatccacaattgccgaattatttgcaaaaaacgaatattccagacacatctacatcgatttctccaaacacgattcccgcctaacggatctgttcgaagacctgagcgacatggacagactgttccgcggactccagctgtacaccggagtcgaattcatagagagggacacggcgataatattcgacgaggtggaggaattccccagagccagggaagccataaaacatctggtggaggatggaagatacgattatatcgaaacagggtcgctcatatcgataaaaaagaatgtgaaagacataataatcccgagtgaagaagaaaaactcgtacttcatccgatggattttgaagaattcctttgggccaaaggaaacaatactttgcaccttatgcgcgattacctggaaacggccaccccccttaacgatgcattgcatcacaagatgatgaaggaatacagggaatacatcgccgtcggaggtatgccgcaggtggtccaggcatatctggataacaggagctatcaggaaatagacagactgaagagacagatattggacatatatctgaacgatttcagaaagatagatccaagtggaaatctggaatcatactacagatcgataccggcagaattatccagggaaagcttgcgctaccgcataaccggaaacaacaagagaaggatatccagggaatccaggtcgtttttcgaaatggaggattcgcgtacggtcgagatgtgctatcatgtggacgaaccccgcattgggctcagtctcactctggaccgcaatttcttcaagatgtatacggaggacaccggcctgttcgtgacgttatgtttctacgacaacgacttctccgataatgtgatctatgagaaactcgtgagcggaagacttcctgcaaatctgggatatgtctatgaaaacgcagtggcccaggcacttgtatcgtccggacaccttcttcgctaccatacgttcaaaaaagaagacgggacccattactatgagatagacttcgtgatctccgatggaacgaaggtagtccccatagaagtgaaatcatctaacaccgcatcccataagtctctggacaaattccttgaaaaaagaagcagggatgtggatacggcatacataatatcccccaagaacctgaaaaaagaagggaagataacctacctgcccatatatatgacgggattcatctgaatcgtccggacagaaacgggacatccgggctacatctggaacatcggagtataccgcaccttctgcggacccgtcttcgagacggctgggaatcgaaccgggacccgacatcctccttctgacatctggcacaatgtcgatcatgacggagtccgacgatcatgcccttttcggattccagcatatgagcttcatctcgttctctgcggaataatgaagcacttctccgtctagttccggcccgaggatgtccttcactatgcctgcgatgtcggcctccaccccgtgggcacggaacgccgattcctccttggctatcagttcggaaagcgggatatccgcctatatgcaggtcttgaagaactccacatgcggatcgcgtccgctctccttcagacggtcctggacctcggtcgatctgcggaagccgtaaccgtaatccttgcccagcctcttccagatctccgaattcagatcgtcgccgtggtttacgacccaagatacgaggatacacgacctgcgggcggaagcctccatgcgcaagatggactccggactcccgctgccgggacacaaggtggcgatacacgcatcgaatcccatgtctggcacatatgaattccaatcgttcaggacgcatgttatgttatccatcccgcggacagacgcctctgcggacaggcgggagagcatgcgcggagacgtatccatgcaggtaagggtgcgtacgtgcggagacatcaccagcgaatatgtgccgggtccggacccgatctccaggacgtcgtcgcctccttccaacatacccagttccataaggcggtccactatgcgtaccgggatgtccccctgctgcatgccggaatactggtcggagtaatcgtcccagaatttcagggtcttttcgtaactggtcttctcccctgtgaacggatgtatgtctgacacgagaatcacttcctgcggtgtccgcctacccctgccccgacgatgtcgtcgtactgcggctgctccctgcacgggatcacgacggtctgcccgccatggtcgatcacgtcggcctctatgccgtacacctccctgatgatctcaggggttatgacctcgcggcctccgaaggcggcgatcattccatccttcacgaacacgaatttgtccgaatagtatgctgccagattgatgtcgtgcatggtcatgaccgtacagaggccgtgctcccggaccacatgttcgatcatcctcatggttatgtgctggttggctatgtccagattgttggacggctcgtccaggacgagaagctccggctcctgtgctatggccctggcgatctgcaccttctggaattcccctccgctgatctcgtcgacgaaatccagggacttgtccccgaggcccagggactctatcacgttccatgcgatctccaggtcgcggtcggagaacgccatccccatgtgcggacgccttcctatgaggacggaatcgaaaaccgtggtgcgcgtcacatcggccttctgggggacgtatccgaccagtttggccatctccttggacggtatcgccgacagatcgctcccgcacaccctgacggtgccggaatccggcctgtgcatgttgcatatgcaacggaggagggtggtcttccccaccccgttcggtcccagtatggatacgatctcgttcttctccgctctcagcgagacccctttcaagacctccttcgactcgtatgagaaatgcagatcctccacttcgagaaccgtcactcccctcccctcctggactttatgaattccgatatccttcctttcttcttacggtatcccatgactagaagatacaggaacagggggccgccgaggaaggaggttatgatacccaccggcaacgtgaaatccatcgcggtctgccctatgcaatccgagacgaggagtatgatcgcacctacgaacatggagcctggaagcagataacgatggtcgttccctacgaacctgcgtacgatatgcggtccgagaagcccgatgaaggccactatccccatgaatgagacgacgaccgccgtcaggagggccgacatgaacagagtggtcagcctgagaccgttcaccttgacccccagggaagacgccacctcgtccccggcatccagcgcattgtagtccatacggctgtacaggaaatagacgatggccaccaacgacactacggcgatgagtgtcagctcgttccatccggccttccccatggaaccgaactgccagaagacgatggttgacagcgcatattcgttgaacatgtactgcagcatgctgatgccggcggagaagatggagctcagcgccactcccgccaggaccatggtctcgggactcaccttcgtcaccttgaccaacagtatgatgatgcccgtcgcgatcatggcccatgcgaacgcgctgatcgtcacgatatacgggttgtttatggatatggtggcctggctctgtccggagattatccccccgcccaggaccactatccctatggacgccccgaaggcggccgcattggatatacccagcgtatacggggaacccagggggttcttcagaacgcattgcatgacggcccccgcgatacccagggcgaacccggccaatatgcatgacaatatgcgcggtatgccgagatcccagaccaggatctcgttcacgggattgttggaggggtcgttcttattgaatatgatgtggagaagttccctgtaatcgatatgtcccagatctatctgcagggtcactaccgcgaagaacacggtcaggatggccatcgctgcgattatgtacagtttccgatgagaatgccttttgaattcctcgatcccgtgtccggccatgtgcatcactgtgtgtggggaccccctcgctgccgagggggtcggagtgtttgtaaggtgacctcaggccactaaagatagttttccgtcggagcctatgctgacgtccccgtagatcggattgcccctggcgacctcgtggaacttactcatgtcctcgaatatcgtggtcccttccgaaggcagaggtacggtgtacgacttgaattccgatatattcctgttgctgagatgggtcttgtagaagaggtcgtagaccttgttcaccttctcttcgaactgggtctcggtgaggacggaatccccgtacgcatatctcattatctggtatgcgtcgacgaagatggtgtcgtagttcataccggtccagatgtaatcggccacgatgtgtgcgtcgtgcccctggaacagtttggctacccccatggagtcgttgctgctcccgttctggtagtatccggaagcgtcgacgaagaggattgtatcttccttcatgcccttggcgatgttcgaggcggaataggtcttgaccccggaaccttcgtaatccatcgcatcggagaggatgttctccactcctgcaagctccatgggcatgtagtagggtatggacgagtcgaggccgtgggcaccgttgtatgccagcgctccgacgtacccggtcctcttgtccgttatcttggaagacagccccttcaggtcgttcacgaggtattcgaacgcattcttgagctcctctcccctctccccctgcttcagtacgatggagatgatgtcgatctgtttctccaggtcggaggtgatcttaaaagtgtccttctcgaggaaggtgtagatgtaaccgatggcgagggtgttgattcctgccttctctatggccgccatctgggtcggataatcgtcatagaaaccggccgggatgaccatcacggagggcttgagattgaggatggtgttcacatcctcatcggttattccgcaattggtgtgggtgaagtatgcacgtgcggcatcctcattgctcaatttggcactgttcccgccttcgatgtcgacgagagcacggcccgtgtacatgaatgatttcccgaggtagttcgtcatgtcattctggtccaccatgacacatttgcccgccagaccgaaataggtcatccatctgaaggaatcctgtcccactgcgacgatgcctccatcgagattgtccaccacttccagattcttccctgcaaagtccgtatcggctttgggcccgtcgtcattgttaccgacgaccatgaatgcggagacgccggcgatcgcgaggatcgcgacggccgcgattgcaatgactttcttgtcaaccatagacgatgattcttgtccggatatataagtatcaccatttattttattagtaacacccaatatgcttttattccattataataatattaaatacatattctcataaaatagatgatacctaggtccgaaatgacctataggatggcgagcaggaccatacttccttggatcttggaacgcatcccgtcgaagaaagactccgattccatggaataagtacttgaacgacgtggacatccaccctacaggcggagaccaccccttgcggccgccgcctcaggcgatgaaaatatggcactgatcgcatgcacctgcccccattgcggaggggtcgtcaagatggaggacacgttggtgtccgggttctgcacatattgcggacgtcagatcatcaacgacaaggcggtagtcggaaacgtcaacgtgaagatggatcgcacacccgagatagtaaacaccctcaaactcgccaagtactccatgtacgacaaggatgccaacggagcccgggtgcttctgtccaaggccatgcagatgagttccgaatactccgacgtatggtacatggatgccgtcctcgacaagagaaacgccaaggcggacatggagcgcgcaagacaatacccttcgctgggcatattcaccgaatcggatgttagcgtctacaagaacttcgacgattccggcggtcaggcactcctcatattcagcataatgatcgcattcttcgggatattcatatccctccccataggcatcatcttcgaagtatactatctgatcctggccatgttcatcataggaatcgccctcgtagcggtctcgatcatctacgtgaagaaacacaagtccaacatccccgcccctgtgttcgaggatgaggacaacaaagccaaacaggccgctctggacgaaacgaacaggagactcggatccgaaaaaagaccctgagtcccggaccatagcaaacccatttgtctaccggcccccgaaagggggcctttccacacaacccccttctccgaccgcgtgtgatccggacggcgactatgaaccggatcacttctccagtacccattttatgcctttggccgtacgcaaggcggcatctttgaaatggttacccgggtttaattcgaacaacgtctcgaccccttcggagcggatgaccgcctccgtctccgcggtggcatcctccaccttggacaggacctcgttcttcgtacggcactccctgtcccccacggacagatacaccgctttcacggcatcggacatgctgtgggtctttacgaaatccgtgaatccgggataccacagcgacccggatgccgaaacagctttggagaacgcatcggtccggtacagggcatacaatgagaaaagcccggccagggagtaccctgccagaacggtctccccgggatcgcagggaatggaaccgcgtatcgccggaaggatggcctccgtgagtatgggtatgtagtcgtcggcccgtccggggaacggtctcccctcccccatgacaggagggaccggccacggcgtcatatcgctgtcccagtcgacgccgttgacgaccgcaagggagaatgcggggcaccccgcatccatgcatgcctgccacaggataccgccctccccccgtaccgcatgatatacgaccaaaggacatccggccccttcggcagcatacagttcgatgatcttcccgtcgacgcagacctccgcactcgaaacatccgacaaagccctgacccctttttgaagacactaagggatccatccctatcaaatgtatgttccgggatcggaaataacatcgtaccaaatatatcgtcgtaaagcatccagcacccgtaggggacaggattacgtatgaagccggaggagatcagggaagtgttcatgaggtctgcgaaggacctcctcgactacgacgaggaaggccgcggaccggccaacgtcgccgtaagggtcgaatcctacgaactcgtagggaagaacagcatcctgctctccctggaggagaatatagacgacaccctcggcgcatatctgtatgtgggggacttcctcgtcctggacaaggacgtcgtgtcgtactcgttctacgaccgcaacaccaagaccctcggtgccaccatagacaacccggggatcatcggcatgatcgccgcggaacatccggagatgaccgtggagttcgacctcagtttcctgatcaagaacgcccgcgactattatgacgaacacggggccatgataggttaccccgacatatgcccatgtttcccggaggaggatatcgtcttccctgcgaaattctcacccagcgaccagcagaggaatgcggtgaggaccatcctcaactcgaagctgtcctatgtatggggagcaccgggcacaggaaagacccagatggtcctggcgaccgcgatcatggcctatatgcgcagagggaagagggtggcgatcatagcccccacgaacaactccgtcgaacaggtcttgagaggcgttctgggcgtcatagggtccgacgaaggattcaggcgcatggtggacccggcgaaagacatagctcgcataggtacggccaccgaacagttcgtcgaggactacccgtacctgtgcgagggacagagcatatccatgctgatatccaagaggaggaaggagatcaaactcctcaaggagatcatccaggagagggaactcgacgtcatagcatcgcatttccgtgccctcgaggtcctggcgaaggaaaggaaacagccggcggaccgtaaggccaaacgcgatatggacgatcagatcgaccagctgatctcggagataaacgcggtattggaggagaacagcctctacagcgaccttgcgagagacctgacatccatgaacttcgagcatcagctggaggccgccacccagaggctctaccagagggaccgccccaagaacagcataccttagtatgacgactgttccagagaggagatgtccgcgaagatcgaagagatagaggaggacatcgaaaggctgtcgccactgatggcggagaaggaccttgaatgtgccaggatagtggcgtgcaccccccagatgtatatgatgcggttccatccgaacggatgcgggaaggacaaacccgaactgggggcggaccacatattcgtcgacgaggccggatactgcaacgtgatgaacgccatgaccctgttcgctaaccatgttccgatcacgttcctcggagaccataaacagctgccgccggtatgcgcggtcgacagccaggaccttcaaaggttcatagacggacacggaaggatggaatatgcgttcctttggtcccagtcggccctgttctgcgaaagcatactgacagacggcatggaggaaatagagagggcgttctcgaaggtatcggacccccatttcaccgagaccgtcagatgcgatctgacggaatcccatcgcttcggcccgaacctggccggaatattggacagacacgtctacatgaacgggatcgagggggccgggggaacgcctctcgagataatatgtatagacgtgacctgcggcaaaagggaggagagggagaatccgccggaggccgatgccgccgatgcattcataaaaatggactgtccggaggacttcgccatactgacaccctacagcagacagataagggtactgaaggagaagatgccgcagtacaaggacacccgcatattgactgtccataaatcccagggaagggaatgggacacggtcatccttagcgtacaggacaatgccaacatcaaccgcgaagtgcctctcagattcaccagttccaagaccgaggtggggatgaaggtcataaacaccgccgtctcccgggcaaaaaggagattggtgatcgtatgcgacaggaccttctggggatccaggaaggacgagctcatcggagacctcgtatccgaagataactgcagtaccgtatacagatacgacgaggaccggggtctgaagaagatatgaagaaagtcctgagatggtcctatggatccaagacctactccgccgaggcggaactctcggaaagtccctattaccgcaagtgccagatggaaagattcctggagttcctccccttctattccaccgtggacgaccctgtgatgaagggtatcgccgacagcatatcggaccaacttcccggatatgcggacgacgcctatgccgccaacgtggtcctcgccatggtgcaacagaacgtggaatatgccaatgacgaggacctctatggggtggaggacctatggggtctccctgcgacggtcctggataaagggaagggagactgcgactgcatgacggacttgtatgtatccgtcgcatccaacctcgatatagatgtcgtatcggtcctggtggaagggcatatgttcccggccgcacatgtggactggaacggggtatgctacgacctcggagggagaagatacttccatatggaggtcaccgacaggatccctgtcgccgggagatactggggagagaaatccgtacaggcatgggccagacccgccgtcccctcggagaggttcagatccacgctgacggaatgccctgccggaaagaacacatcgtccgcatgacgctggcacattgggtactcgatccacagcggacggattttcgggactttgtaaagatattggatgacctccggagtggtggacagcgttccgtacatgtatctgcgaaaggggacttgttggaaacgaacgataccgaccgacgacgaacgatactgttacttcttccaccttttgagcgtcggaaataccttggaacagtgttcacgcatctgctcgttggtcataccggcctgttcaccgaactcggaacacatgtctatgaactcctccatcgacacatcgtggagaaactcgcctttatcgtaacaatacctgcagtaatcggagttgaccgaaccgtccctgtcggtaccgaggaccgaatcatcgggcatcggcatggcacagctctgacagaatctgttgcatcccatacgatcgccgtaatgcgattgccgggatacgatataaaaagatgtgcgtacaaggtccgagtcccataggaaggttgacgacggatggacacacggacatctgggtctttgcagagaatgaaggaagaaggacttatccgctccctctccgaccgaccggacccacgttaccgcggttcaccagcatcacggccagaaggatcactgcgatacctatcaccgactcggccgtgacggcctccgaatagaagatgaaaccgaccacggtggcggtcagaggttccacataggttatgacggatgccgtacccacctctatcttccctacggcatagttgtacagaccgaaaggcaggagcgtcatgagtatgcctgtggctattatgagcaatacgagatggccgtcggatgaggccgcaccgaccacaccggggatatcgctgaacggtgccagcgacacacagcataccagggaggaatagaacaggacggagatcggactcacggaatgtctcgacagccctttggatcccagggtgtacagtgcgaagaagaaccccgacagggcccccaggaccactcccgtcacatcgatggatccgggatcgttaagaaaaccggtacacagtatgcagcctgcgaatgccatcagtactgctgccgccttcgtacgtgtcatcctctccccgaacaaagggacggagaggaggattacgatgaacggtgctatgtactggaggaccgtggaaagagacagggatatccgctccatggccccgaaataacatacggagttcaacgccgtcccgagtatgcctatgatcagaacggttgcgaatcctctgcggtcgatacggaaaaggtccctgcggaaaaccgacatgaatatgccgagtacggccgccaccacgatataacgcagacaggtgatctgtacggatgaaagcccttcgccgttcagaccgcggacgaacagtcccaggaaaccccatactatgcctgcggagaaggccgccgcgacacctaggttcctgtatctgggattcatcgcacccgattctggaagatactatttgaaaagtcctattgacggggatttattggaaagacgtagatccacagcatgacagggccgtccgcattccgccataaataacggaacgggaaggcggatcgcgccggccaccctgcaacggccacctgggtcgaatccggaaggaaacagacgccggtgacggagacaaccattatgtggaatttgtacgatcaccgcccatggaccataaagaaaaggccctgtggtatttcaacagacatttccattgttcccaggccgtccttgcggcttttgcagacgattgcggaatcacggagcatcaggccctgatgctcggatcatgtttcgggagcggtatgaggaaaggggaggtatgcggggcatgcaccggcgccctgatggtcctaggattactctatggatacgacgaccccgctgtatcgaaggataaaggccgtgcagacgaagtaaacgacattatgatggagcgtttctcgaagagatgcggttcctacctgtgcaacgtcatattggattgcgacatctccacctccgaaggcgtgaaacatgcacgtgataaccgcctttttacagagatctgccccaaagctgtcgagaccgcggtcgatatcctggaaaacatcatcgaagaaatggacgaccgactcccgccggacgatgggatggattccggccccgtcccctgatacgggatccatctggcacagcgacccggatccagatgtgaaacatcctttctgcacaaattccttgtttttaatgctgttttaatacactttttcaaagaaaaaaatgctataaattacacttttaccaagaattaaataaccacgcatcgatactctatcgatgagtgtgatattcgaaaggaagataggttctgcgatagaggactatttcgagaccgatgatgccccgatcctggtgatagatggagcaaggcaggtcggaaaatcattcatcatacgtgaattgggtaagaggcattacaagaacttcgtcgagatcaatatgatagaagacaaagagggtcccggcctcttccaaaacgtccatacaaccaaagacctctattatacagtacaggccatagccgacagacctctcggagactatgacgataccctgatcttcctggacgagatacaggaatacggccatcttctgacccttctgaaattcctcagaatggaacatcgctacaaattcattgtcagcggatctcttctcggagtcgaactcagaaaaacatcatcgatacccataggcagcatatccacgaaacgcatgttccccatggatatcgaagaattcctttgggccaacggtatacaaagagacctgatagacgatctgaaggacatgatagcgaataccgaggagataccggacgggctgcacaaaaggatgatggaccttttcaaggactatctcatctgcggagggctcccgtattgcgtagacatattccttcagacaagagatgtcgttaaactgagaaatgtccagaaggagatatacgaactgtatgggaatgatgcatccaaatacgacgtaaagaacaagatgcacacgaaggccgtattcgattccatcccatccagcatcgagaacaaaagaaagagggtgttcgccaaggacatagagggtaaggagcacgcccgcttcgatgattacaaagatgatttcgacaacctcgtggattcgggcgtggtcctgcaggtcacttgctgttccaaccccgtttttcctctgagggaatcctccaaacgcaatctgctcaaacttcacatatgcgacgtggggctcctctcctgtcttctctacaggaacaatgtaaggcctctcagagaggatataccgcagatcaacctgggcaaggtctacgaatgtgtggctgcaatgcaactgtcatccaacggacacacactctactattgcgataacaagaaccatggggaggtcgactatctggtggatgattacgacgatctttcggtgaaagcgatcgagatcaaatccggcaaggatcacaagagacacaacgcgatcgataaactcatggatgtcaacgattcctgtcggggctttgtcctatccaactccggtaacgtagaagtgcaggacaggatcacgtatctgccgatatacgcactcatgttcatctgagacagagacggagagagttccatatggggatgacatcggtgtccgggcagcgatttcggatcgacgcccggtatcctgacgacccccatcacatccgtgtcacgaccgtagaccgggattcccggcttcgaatcacgtcactccgagggtcccgtgaccggtacgcatacatactccccctgtcgccgaccgtcctgtatgtaccgacattcgccggagtcgggcctccatacaggatatcgtagaaacgggcctatcagggagtggagaccattactgtccagatctcccggcggagacccgtttaaaattttccgcgaaaatttgacgtgtaccactttacgcgcacgtactaagaagattttgcaccacagaaaacggtccgattacggaccccttttcggacagcacgttcctaagaccagagggaagaaacctctcatcaacaacccgaacaacggaggcgttctgccatgaatccctccgatgcgatgatgtatctgaaggccttgggatacaccctcgacagcggatacgtgttcaacgggaaataccgttatggaaggattttcgaggatgcattcgtccccgagggcgattcctccgtcccgataccatggacggagattgttgaattccacagttccgacagcggttccttcggcagcaaccttatggtcataaagacggacggcacggatacggagctgaaacgctctgagctccccgagaagaacggttattccgggctgaaacccaatcccaacggagaggggttcctgatgccgtacagcatatccgacctgatgaatgcctggaggtttgtcttcccagaattcagagaaaaatgctggaaggaaatcaccacgaattacatcatggtggatctctccctcatcggagagaggggatttaaaagcctggatgacccgatgatcacccgcatagcggcatacgtacaggactagttgaagaaacttggatgcaagggcaaacagccgggaaaggatgtcatcagagatgttctgatcgcacaggccgaactcaactccaggaatgctttcctggatatgatgcgctcgaaattctgggacaaacagccgcgtctggacagattgtttatcgatgtgttcggtgcgaggatgcgcggtctttccgaagaggattcggaagccgtgttgaaggatgtgtgcaaatgctggttcctgggtgcggtagcacgtcagcacagggcgatccaactagacatcattcccatcatgattggtgccaccgggacaaggaagtcctccgcggtaagatggatggcgacctgtgacgagttctacagggatcccctcgacatcagcgagaagagattcgttgaggacaccaaaggcgggctgataatcgaactggcagagatgaaggccaccaaggggatggataacgattacctcaagggtttcatctccagggcctccgaccacataagactcccctatgacagatgtgccagcgaaaacgtccgcaggttcgtgatcatcggcaccaccaacgaagcagagtttctgtctgaccccaccgggaacaggagatacttcccgttcacggcgaacccggagatggcaatcgtcggtttcggtaaaggaggtttcagatcagatgaagcgaaggaatacatcatccaggtctgggctgaagcctatcacagatacatgtcaaaggaaggatgggatctcgatccgaaaaccatccagatggcaaaaatcgcacaggaagcatccaccataaacaacccgaatgtagacatcctctccgaactggtagatgaactatatcctctccctggagcaagattgtgcaggaaggatctggaattcatcctatcgtcgaacgctgggatctacggtgatgaggccatcaaagctgccgacctgtggatgagatcgccacacccgggatggagcaatatcgccgccatgaggattcacgcagaagggagagaatggatgaaacaggcaagcaccacccagagatgcagagaaaggatccaatcagtaggttacgtggcaccgccaccaacgcacatgctgggggagtgatgttacagtgttacacccgtttcactggcttcatacgcgcgcgtacgggggttgagaggtctctcaaaaccactgtaacaagtgtaacagtgtaacagatgagataaaagatggaaattcttggaaaacactcaaaaaaaccacttcaccagagccgagtaaacgagataactaattatcataggatgtgcgaatcgttcgaagcgaactgtttcgtttactcccgctctgggcttctattctacatcactaatatctaatcaggaaatcatacgttgaatatggatttcctgaggaatcttatcgattcattcaatgtattcctggagaaacgtcgcgagaagcggcgtatcgagcaggaacgcaggcggatcgagagggagagacgtctcgaagaggaaaggagacggcaagaacaggagaggttcctgtaccgtctcggcaacgacttcgaggattacatcatcgagatgttcgatcccgagaggttcgagctcatccaccggacacccaccaacgacgataccaacggcagattcgttcattcgatggtatatcccgatctccgtttcagggagatcgccacgggcaggaaattctgggtggaggtcaagttccgggcacgcaccgaggacaggggcgtgattacctggtgtaacgacaaccaactcaggaactacaagaagacgatgtacgagtccaggaatccggtgttcatcatgatcggtctcggaggaactgttcagaatccggagaagatcttctgtctgaatctcgataggatcaacttcactaccctatactatggaacatacgttcacaacagagttatcaaccgcaggatcgaatccttcgaagagctgatcgccatcgacggaatggctgaaacggacaaccatttccgccattgaaaactcgaaaacctatcaaaatcttacaggttaagatatagatatatgcgtacgcggggtgtgttttggtggtggttttttccacattacaatgagtcgggttcagaaccaacccgaaatcatttttccttcccttgtcaaagtgacctgccggaatctgcgatcattgccaccaatcgaagtttccaccagccccatgtcttccaggttgtgaatgtatctcccacaaagctgtctggacatgcccaaggaatctgctatcgtactgttgttctctctgtttccttcatccaagattttcattatggacttctcatggtccttcaaacgtttcacatcagggatcttcggtgtcggaacctctatcaaacgttcagataatgattgattgggatctttggggttgtaaagtacgtagtaaatcttggcacctgtgaaaaatgccgttgagcaagcggcagcagccatcaagttggttcccccggtgatattgatggaatatctcgtattcctttcgttgttgtggttgtagatctcatagattctgtccacaatctcttgaaaatcgaatccatctatctggactatatcgcagccatatccttgatccacgaatccagatttggtatcttccgcttgggcgaggaacttctcactgtaaagcaagtaaatgaagtcgatgtttcctattcctctgactccgttcttcactggctccgggtgttcgcctatattggcgatatgaatgtgcattagtaaacaaaatctgtttacaatatatcaatttttagatattaatctgaaagaatcatacatgcatggaaatagaggagaaacaggccggcaagatcaaatcagcaaatattcatgttattggaatctgcaattaccattgtcaacactgtttcgaccggtgcctgacccatcaatacatgactcccaaggagtggaagcctattctggaatatctcaaagaaagaggggtggagaaaataaacattgcagggggcgaaccgttcctctacccgtatctgaatgagatgtgtagacttctcaaatctataggattcaaagtttccattgtaagcaacggttccagaataacacagcaacagcttagagaaatccaaccgcatctagattggctcgggctttcagtcgattctcctgatgaggaggatgagattataattgggagacacaccgcgggcagcaatcatctagataatatcaaaactgtagcttgtgaagctcacaagcttggaatcaaggtaaaattaaacatcacagcggtaaggagaagcatcggcaaaaactttggagaactaatagaatcaatccggccagaacgtgtaaaggtgttccgtgctttgactctcaaaggtgcaaacgacgatatcccagacacatggtcggtaaccaatgatgaattccaatcctttagagaaagacacttgacgattccaggcattgtattcgaagacaacgaagacatgatcggttcatatctaatgttcgatcctataggaagatggatggtaaacggcgggggaacaaaacgcttcctgtcattccaaactcttgtccgggatggcttgatgtccgaagtggaggcctccaaatactacggaagaaatgcagtttatgactggtaaggaccacagaacaataaagtgtcaacaaatacacaatccagaaggatggaacatggcaaaatacgattattcaagattcaaggatccagattggtcggatgactgggtctatcaaaaacccaaaccgtacacatacaatcctgacaaagaacccaacgaaacaactgaagaagagaaggaatacgtcggatggcccgatccgcagatcgcatgcgacaaagaatactggggaattcatgaagtcaaaggaggccgtctagaaatcgatgtaagacgcttcgaatatgcttgttaccgctgcggggatcacgacccgtatttccccgaggcccttcggaaaaaagggccgcactatatcgcatcgaaagtccacaggcatgattatactttcaactacctcatggatagtatccgcaacctaaaggaagactggaactacgaatacaaacctctgttcaataaagtattctcccccaaagatgcagaagacaactatcgcacgaatacaatgatgatgttcggagattcagagatgttcgacagcgtcgaattgggttcaaagtgggcatatttcaacagaatgaatacatactatagaatccaggccgagttgtactataccttccttacaaaggtcatcatagaaatacaccggattatcctcagagcaatgacgatgcagctctatcaaaataccgaatacagcgtgtttgacctgaaaacatactgcaacggtgccggggtcgacttctatcatctgaaaaactggaaggtatacctcaagtacaacgacatctacaatttcttgaaacacaactccatccaggcttacgagaaactgaaaaagttcaattcaaaatgtcttattgaaaccgatcaaaagtacgagaacggaatgttcgctatggattggctcaattcgaaagagatcaatatcgatgagctgttgtcagacatcgtgccgttccttcaggacttctgtaagaaggtgctgggagaggatttaaaacaagccgaatgggactatgatgactatttcatcgagacccagaaagaacttgaggacccgatggaacatttcgggatatacggtgcctgtggtatgtccccatgggattgaagcgaacggagacaacactcagtatcatgaatcaacacccgttttgatacgtttgtaacgatccaaattggtttccgatttgttgacggcccatggcagcccataatcctctgctttccttctgagggtggtgacggggatgccgaatgctctcgagatcgactcatctgtcagccccatcgacttaatcctcgaagcaacagcaagaagtgtctcctcgaatcctctggactcttcttctccagtctctttcatgtcacgatagaagcccctgatggcatcgaccatctcgaagctggagacgttcccggtggcggagatgaaggccttgaagtcgaatccgtcaccgacagagaattccgcagaggccttgtggtcgtaacagaactctccctctttcagtttgtccggcggagtcgtccatgacagtttggggatgatagtggcctcggcacgctccagagcactgtatttcatgaagatgatgtcgcgtgtgtcgatgttcagattatgctctctgatgatctttcttgcgaagtcctcatgtctatcccacagcacgctgacgtttcccgggttatcgggatcgtcgatgaagttcctgaacgcgggccccatgttcttggtgacaggtgataagagccagaccgcgatattgaacttccttatgatgcccatgaaggtcttcatggaggtcaccgtgggcgtaccgttgtgctctccgagaaggaagttctgggcctcgtcaaggatcaggaggaggttctcgttcttctccaggacctcggcggcaatcgggaagagttccttcagtgagacgatatgatggacgccttcagggtaatctgttacgaatttctccctatgcttcctgacgaagatcacgttggtggcaaccctccattttcccagttctgggtatgtgccgttgaccagcatctgtgcgaaggatatggcagaacgtgtcttccctccccctctgcggcctgatgtgaccatcagggccccgggcctgaacaccttctggtagtacttcaggatcacatcccgtttgatcttgcccatccttttcctgttctcggcatcccactccgggggctcttcatcatactcatccatcgatgaaggcctccgtatcgatgaagtcggtctttgagttcagttccagaagcgccctcaggagtccggttgtgaagagaagctccgtgatcctcccaagacacttcgcataggcgagcttgtcaacgtgtccttttttcgggatccacccttcagggattacgttgaccttcctgtcgagacagtattcgagataagtctgaaggtcgtagatgtgctctgcatagggattatcctattccaggtaccacaggcattctttatacatgctgttgagttctctgagatccttctcccattccgtccggtccgaaaccgaccgattacggaccgcgtcgttctttataaccgtctgaggggttttctccacccctcccttttggacccctgtcattcggacacctcctttacggacctgttggagatgaggttctctacctcctcccttctgcggagaagagtggtcttcgggatgcgaagatctcttgaaatggacttccatgaattaccggctatgcggagggtgacgattgtgtcgatgggtatgtcgtcccttctcttccttccaaggtggacgcctttggccttcctcgcctcgatcccttctctggtcctctggacgataatttccctctcccattcggcgatagcgccgataatctgcatctgcacctttcccatcggtgtggtaaaatcgatctccccgatatctgcacagatgagcttcacgttgtatgattggagattcatcatcgtaatgttcagttgcacaagggacctcattaccctatcaagtttggtgacaagtattgcatcgaacctatgttcctttgcatcctgcatgaggtcctgccaaccgggacggttggaatctttcgcagaggcctcatcggagtactcacggaagacttcgaatcctctgttcttggcgatctctctcaaacgaggaagttggttagtctcgtcctgtttcttggtggagacgcgaacataaattgcgaccttcattccgaaaagcctcctgaaaagatgcccgaaatgaacaatccgtttaccgcctcgatgatgaagataaacgcatttttgacccttatacgtacccccatacgggcacttttaccgtataaaactcctttggttttcataacagtgccagacgcgttggggattgataatgattaaccttgatttatggacacagataagaattatcctcactcatgcaatgacttgataacaaggtcatcgtaacaaggacttttgatatgctggctaatccgaaatgaacgagggtttttatacaatcattgttatcattcttaacaatgagttacaaggtcgtccagaagcagagcaacggcagatactacctgtacgaggtcacgggggtctgggatcccgtcaagaagaactcgaaacagaccaggacgtatctgggcgtgtgcgatgccgaaggcaatctgctgaaggaaccggccaggaacaggacggtcagctgcagtccggtgtacgggccgtaccagctgttcgtacagctggcggagaggagcggactcacgtccgctctggacgacgtgtacggggtgagggacggaaggaggctgctggccatggccatactgggcatcgtggatcccgtgaccgtgaaccagatggagaatgtcatagacgacacctacctgcgggaacttctcggtgtcgactggggtttcgagcagtcatcggtctgccggttcctgcagaccgtgggccacgcttcggagcagagggaactcctgttcaacgaactcgccccgaagagcggatgcgtaatcttcgacatagtgtgcctgggcacggattccgaggacctcgaatatgcggaggtagggaggaagacccatctcaccggatccagacagttcgatctgggcatggtgcattcgatggaggacaacctcccgttctgctaccgcacctatccgggttcggtggcggacgtatccacactggacaacatcgtctcggacctccggaccatggactgttcccccgtagaactggagatggacaggggattcttcagcataggcaacgtgcagatgatgctggaacgcggaatggggttcaccgtgccgatacctgcacgtgtcggcatatccaaactgctgctgtcggagagcgtcagggagatagactcgcccctgaacacggactatctggcacggtcggttgtgaggggatacgagacattcgtgagactcgaggacgacgaactggtgaaagcctccgagggggacgcgggggcgatcagggcgttggtgttccaggacgattcggagcgtacaaaggagatcgccacgctgtattcgaggatcggggagctcgagaacaggctgtccggtacgggatacgaccgtttcgccaggaagaagctcacacgcacggaacagcagaccgcggatctgctggaattcgccgctgactgtgacgggaagaccgtggtgacgaggaaacgcaatgcgatatccgccaaggagaacgcctgcggaaggttcgcggtgataacgacgtcggacaagcattggctggacctgttgatgcagtaccgtctcaggaacggggtggaatatgatttctcgcagcttcagtcggatctgttcgtgggcataacaggtaaatcggaccaggattccgccgaaggcggactcctggtgaacttcctgtctctgaggctcaggctgacgctgataaacctgctgaaggaaaagggattggcgggcgattactgggtcccggacgtgctgaacaccctgaagaagctgaagatctcgtgcatcggcgggaaatggagactgaacgaggtcaccaaggcccagagggaactcttcgaagctctcggggtaaacatccagtgaaccccttgttatcaaatcgatgcataagtgaggattattcagaaatcaaagtacaatgcaaaaacaccacgaccgtatactcgcagtatacgaaaatgacgctgcccaatccaagatccatgtcatcgatagtctatttttcaataaagtctaaatgtggcctcccattattataaaatagataagaacccctaacaggcagcatacgaggtcgatatcattaccgtatcagaacaggatgtccaaaatattatccgttcaaaatacaaagatggaatcgattttagtccctcaactttaatggttctctctaatttagtaggtgagagaatcaacgaagagctacttaacaacttgaaacaagatatgttccttcgttcagatgggttgtattacttggttgatgagatagcctcggaagatgacctgggccagatcaaaagttctattgaagattatcttgaaaactttggttgttttgaagtcgctgcaatgtgggaatactacaagccaatcattaatgacaggattatcatgtcaaagaatcactttggtgaattggcaatatttctcatgaacaatgaatgtcatattagggattattacaacattagtttcgtaaaaaaacctcgtgttggttttcccccatcatttaaaaaatgtatctcaaaaatagaaactgtggtttgcgaagaatactgcggaacaatgcctgatgaaagcatctcagcagagttttacggtttttcgattaaaaaccttcaaaaaataataaaagacttctctgatacgttgtatttcacagaaataaatggatctgagtgtatccaacatattgataatcttggactaccagaagacttatctgatactatttccaactccgttgaaaaacttgaatcaatagggatccccctaaccctcgaagcaatacatactgcgatttcacttgaccttggtttttcattcagagatgaatatggcatcattgatgatgcaaccctcaaaatgattatacaaagacactgtaaccttgttccaaaacacatgtgggatcattctattctcagggaggtacatgaataatgtactcttatgaatgggatccggaaactcatggctttattttgacaacaaagagtgcaaattacattgcatatgaaatcaggcctgtatacgcccaggaacttgaaattgcaggtttgaatgaacgtttttcatacgacaaaaatgaaactcgccccctgatgtggtcacaaaaaaactattatttagtagatggggaaaaggttgctaaacttaataatacccagtatggtgtaaaactatccatcgaatacctttttgaagggacaatgcaactaaatcctgttgatttagatcgcatggttcagaaaaatgccccaataatggacataattgttgcagatacaaaacgtagggcaaaagaactgtatgataaagatatttcacggtgtgatattgcatatatcgcgttctctggtggtaaagactctttggttttattggatatatgcaaccaagtattcccaacttcagcacctgttatcttcagcgatacagacatggagctgccggatacgtatcatatttgggattcaattaaacaattgtatccagaaagagaatttatccgtgcggtatctgaaaaacccgctttggtcaactggcaattattcggtccaccctctagaggcctcaggtggtgttgcccagttcataaaagtactccagcgatcatcacccttaaacacaaattattcaaggaatcgataaaggtaatggcatttgttggtgtccgcagagacgaaagttatgccagatccctatatgaagatagttcagatggagttaaaaatgcctctcagttaaaccgtatgccaatcctagattggggcgctcacgaagtatggctttacctctattctagacaccttcccatcaatcctgcatacttcaaagggatgcccagaatagggtgtgtaatgtgtcctgaatcgtctacacgttacgaatggttcattgacaaggcgtatccgggactattaaaaccatacaatgacataataatcaacaccactgctaaacaatttaagaacaaggatgatgaacaagaatatttgtccaatctaagttggcaagcaagaaaaagtggtgcgttacttcaagaatatctcaccaatccatttgaaaaaagagaaggcaccgtatcaacttttcaggttcctaattgcccaaaaaaacaattttttgaatggattaaaactattggggatgttgtttttgatgaaaccaccggctcaacatgtgttagatacggtcacctcaatcaaaatttgattccatttaaattcgaatcgaccccctctaattttgcaacaattgtattcacatttaattcgacggaagagcaatcggaactgttcttacccatccgtacaattctccgtaaatcgatgagttgtgtgggatgcagaacttgtgaggcagaatgcagccaaggggcgatttctttcgaggatggaatcgtatcaatagatgagtcgaaatgcaccagatgtcataaatgtcacgaactagaccagggatgttggaggtttagatccatgtataagccagatacagaacaactaaaaatgaacagcataaacaattattgtaacttcggactaagagaaaaagaccaatatacgtggatttcaacgttattggaaatgggagaggactttttcccttggacagaataccacccattgggtagcaaaatggttgttgcggccagtaagtggttccagcaatctctgctaattgatgcaaaaacaaagaaacccaccttgcttctagaaatattcaggaaatatggaggatctagtgaactcggatgggagctaatctggcttgctcttgcgaacaattctctattaataaaatggtatgtaacctccacagatcttggaactccctatagtatcgatagactctccgacatgttgaaagagtatgacggttcgctgacgacctctacaatcaaaggtgggcttgcagcattcaaggacttagtaacaaaatctcccatcggagacacagtccccctagtgcttcctgaaatgaaaggcaagtcatcagttactggtgtgacaagactggcaaaacctattgaatctttgactgttttatacggattgtatctgattgcaaaagcaacagggagatctagcttctctgtacgtgaattgatgacggcagacatggactccatattcgtatcacccatagttgcattcggcactccagtagatgaattcaaaaaattatgtgagggacttcgctccaaatatcccgactacataagcgtcacattcacttatggtaatgatggtatcgagatttaccctcagaaacacagtttggatgacattctgcaattagaattggagggatgacatggcacaccactattctgattattttgacgttccacaggtttacagggccaacatgacccgtgcgattatcaatgaatctcctgaaagatggcttgatttttacccccatgaaaaatatatcgattttcttgagaccttgtttgtcgcgatacatgaaggttctaaatcggtttggctcactggaaacttcggaactggaaaaacaaacgctgctttggtcactcaaaaattatacatggatgacattgagcgggtcagactgtggtttaaacaatacaaggtcaatcgccacaatacagatttacttgcagaccttgaaaaacagcgtgcgggcggaactctggtcgtttatgattataacgcctcagggttagaaccaactattgaattgatagtaaggattgaaaaagcaatcatcgaacaacttatggaattggggttgaaagtgccccttaattcaaatgttgatcagattatctcaagactgcgccgtgaaggggataatttcttcaagataagggataaaatctcagatcaattatcctacataccctcagatgtttatgatatcgaaacaattgtgaaaatgattcaggatgcaaactctgaatcctcagcatctttgcatgttcttgaggacatacagaaaatattgcatacagacggtattttcttgaacgttgatgttaatagtttcaaaaaatggattagggaaatacgtgaacaaaacaaccttgaaagaataatcttcctatttgatgaattttcagattttatcgaagaaaacaaaactcaattaaaaaccttcgaagacatcacagaaagtcctggcgtcgatcagttttatcttatccctgttacccatatgggcattaatgcatattattcagataatgcagacagcgcatccagatccacaaataggttctacttcaaacagctacaaatgccgaacaacatcgcatttgaattagctgccggagccatgagagttaatccaactcttgaaaatgaatgggctgaaatgaaaaacaaattgtgggcttctgttcaacaagttgcagataaattcaatgaaaatgaggttactcaccaatcatttcacaatatcttgcccatccaccctatggcgggatatttgctaaaaacattgtctgaatcagtaggtgctaaccaaaggagtatctttgagtacctaaaaggtagcgcaaacggcagagagttccaagaattcatcaaagttggtggacctgaagaatacggaaaacaattgcttaccgtggactatctttggaaatatttcatggaaagagatgatttaggtaaaaagaaagaactggatgaaattaaactatactataacaaagtacgtaatagcacatacagggctgccacagacgatgatcctcttattcgcgtattgaaagcgataatgttgtttgtactcgtctgtcgtttaaataaaaacggtcatgcgcgccttcaagcaacagtagaaaatatcgaactgtctttcgttggggatggatctattgcgaatgtttcaaggataatcaaagaattcgaagaacaacactgcctatcaataatgaacggcaatattgagttgtatatctcttctatcgatgattcaaacatacaatcaaagatagaggagtatcttcctaaattccacgatcttctttctgaaaaagctcagaatgcactaattgtccacacgaagcaggttttcaatcaacaccctactggacgtttcgacattcgcgttactagcaaagatcgctctagtttacaatttttgagtcaaactcaaaaagaaaaatatggaaaagaaacagggcaggtctgtgtttggttctctatcgcaaaggatcatgaagacagtctagggatccctgaaaaaattaacaaaatcttgtcgcaaactaaagacgattaccgcatcttaatggtagaatttgatggcttgacattctgcgacaaatctgcaactaattgggaagaatatgttcggctatatgtcaaacacatgaccgaaaatgattccggcgttaaaaaccaactaaagaagagtctagacaaaatggaggcggattggacatataaaatgaaaatgccctctgccaaaattattgcttattattatgaagacggcgctgtacacaacacagtatgtacttggcaaacgttcaaaaatttcatctctgagcgtgttaaatacatgctaccctacaatactgatgagttggcaccgattataactgcatactcgatcaacggtctaaaaaaatatgcactggctggaattgatttcaacactgcagaaaaacaaactcgccaggttgtacaattgctacaaaaaggtggggttactgcagataaaaactggttcgatctaaatccagatcacccattgtcacacatacatgagttattcacgaaaaaaatgaacaataccgtgggcagaggttcgaatttcagtatacgcaaagctttcattgacctccgcaaacacccatatggtatgatggataatgcgtttagcgcgtttactgttggtttttgccttaaagagatactgcacaacaactaccagtggacggatggtaaattaacgaaccctctagatgcagattctttagcagagatcatcgaagatgcaataaagactgttgataagcccagggatgaaaaaaccatctgcaaattgtcaaaggaggataaagcgttcgttgaatcggcaccggtcatgtttggtctgcaaccaatgaacaattgcacaacgaatgaaacaatcggatatatttccaataaaatatcaacaatatcctcaaaggtcccgttatgggtaatacctgactatgttgacggacaacaagacccagattgtacgataattcgtgaaataatcgaaaaaatctgcctcattgcacggactagttctaaaggcaatattgaggaaaaatcagaggcaattagagacgttggtgcaatcctactgaataatgagggaattatcaagtccgtcgccaaatacatgaatcaggtgacgtttaagtctgctttcgaacagtatatcgattctagatacccagatatgaatgcactggcatcttcctgtcggagatctaactcataattatctaaactccatcttggataaggccgcgagtgctgcgtcatatctatggataaaggataatctcgatgcgaacgtatctgaaacgcaaggtgaatacaagcttatccaaaccttaaagccattagtgtcgccctctgacgtgaattcggcacgttgaggaatcttttattttcggcgtgaaaacgtcgttttttctgcaggatccagggtgtttttcccgggttttcatgacggtcggcatagcgtccgctgagatatgctgcgtaccaggtagaggaacacgcgcacgttatttatagtttagcgattataatcgagtaaaactcgattataatcgctaaaaattcaggagacgcgcgtaccctgcgatataacgggcttgatgaagacatacagggtaccgccatggcattggaccgttctagggacaggggatacgtcggcctgagggcgacgtccgcgttagccatggcgctgttcgaacaatccggtctgagaggactgttggacgaaaggatccccgtggacaaacgtcgcaagctcagcataggatatgccgtcaaagccttcatcggcgatatgatgggtcatgcggaccgcagggcactgagcagggtctccgacccgttcatgtccgctcccgtatccgagatgttcggggagaagatggatctggagggattgggtgcaaccgcattgtcaagggacctcgatatcatgttcgaggccggatcttcctgctgtcacctatgactgctaccgtcttctggcctcaagatacgggctggattcgaacatcttcaacatcgattcgaccaacttcggcatatccgcgaaggagaagaccgccgatatcgagggtgcggcagtaccggaatggtgcggacatcccaaggattcgaaggccaggatagtctacagcctcctttcggtcacggacgagaacagtatcgtctgctacgaaagaccgtatgacggtgccaccgcggattccgagatggacaggggtgccatagagttcctttccggtaaggtggatccctcctcgaccacattggtggccgattgcaagatcgccaccgctcccctggtggggctcatgacctccgaggggttcggtttcgtagcgaagtgcccggagaacttcgggcgcaaggtgagggacgatatcgtttattccgtatccacgggaacgatggatccctcatccgtacgtgacggatgggagatatacgatacggatgccgaagtggacgggatgatgctgaggttcgttgcctatcgcacatccgatgatatccaggcgggtatcgagtaccgccgggaacaggatctgaaggaagcgcaggcgctcctcggtcgtttctcctcgagactgttcaactgcgaggaggatgcacgcagggccataaccgaagcattggggaacctcagcgattcggcgtacgaggtaggttggtcggtatcggaggtggaatcccgttcctacgggcacagaggaagaccgaggaaggacgagaaaccgaccgtgagaacggaataccgggtggacgtttcgctggagttcgacgaggagagagccaaggagctctcgaaggaccgcagcgtaagggtcctggtgaccaacctgccgagagcgaacggggacgcggagaacatccgcttcggcgcaacggcggatacggtgctgctcacatacctggggcaataccacgtggaacacgccttcagattgatgaaggacgggatgtccatgaagaaggtgtacatccagaaaccttcgagggagaacgcgatgatgttcgtgatctcgatagccaccatgctcaccgaccttgcggaccatgttctcaagagggaaggcgtcgataccactttctcggatttcgtgagacgttccgtctccctcatcctcgccagggatcccgtatcgggtgacgagcacttcatgggcccgtccattctggcggacgagttcatggatgtatcggaagcgttgggcatcgatacggacaggctgatgtgctaaaggagccggaccctgtgcagtaacagcgtgagctatggccctggtcaaaaataatcagggcaacgtgccgaattcacgtctgaatttgtcaattacaagcaagtagttaattctctgaaaaatgctatctttgaaagaaataagattccaagaagtcgcataatctctatttatccgagcttggctgacctaatagattgcattgaatcactggacaaaccccagaatgtaaaaacgattgaagagatccaacagaccgttgcagcaaattataatttgattgacaacttgttctacgattccaaaatggttgcaagtttgaagataatcaaaggaatggtggaaacgggacctatacctgactcggaactcatcaatcttattcaggacttatcttcaggatattcctcccctgaaataacatttacaagggaattaaaaggaaagatagaggattacgagaaaaagtcacttggtcgtaaattactcaacaggtggaaagaggttacccagagttcctctccttctgaatgggctgcaactaaccatatgccagcatacttcgtatttttcgattatgacaatccaaaattgataatccagtgcatatctcatcccgaagattatagtgctgaaaaactgaatgctatcatgcagtctctaaatacagcaggaatcaccgatgttaagagatgccaggcagcattcatagacgagcacataccttcaaaatacaagggatttaacattagcttcggttcattagctagctatctgatgaagagatattctggttcaccaaacacttggccagacaaattggatttgtctgaatatctaacttctcagtataaaactgaaattgccccacaggctatcgctgaaatcaagcaaatgaatgcagaagaattgaaatcaaaaatcctttctcttgctgcggacaacgaagatattgggctgattttctggaagtgagaatatggggtttgagttggaggaatacctggggatacctaatgacaataacacatgccttgaggttgtttccaacaaagatcaggagtacaatttgatatatcagcacatatcaaatggatcgaaaaacgtccccatatgggaactaatctcagaatcactaacaattgatagacctaaggtattgtttgaagtcataaaaaatcaatatcgccatgaaaataaacctgtcacaatagccggtatttctgcatacttatcaattctggatgaaggcacggtacatgatttttatgtagaattgaaaaatcacctggatcaacaagatttgaatgccaaacttgttatcttatctgagtattttgattatacgccattctctaatccaaaataccaggattcacttcagattgtgataataactggggaagaaaaaatttcaggaacccccacgatttcaatctgtccagaacaactttgcctagatccttcagcctttcactcatatcctcaattattggaggccctgaatgaacctcacgaggactttcaatacaccctagcattggaaacccgtaagattagcagagttggactgaacaaatcgattaatgctacagataatccagaaataatttttgaacaaatgaccggctgcagaatcgaatgtggagaaatagatatcgaagcattattccgcgaatgcaaaacgaaatcaatcacattatcccagtatatggatgaaaaaattggattgactacagaccctcgggaattgtttgtaaccctagtgtctcatcttaatgatcctttttggaaagtgtattgttactatataatgaaaaaaatcaatccgaattgcttcttgtcgaaggttttatcccagaaaccaacatacaaatcatttcttcacagatatgttgttgatgccccaatcgaactaatcaatgacacaaatgcagaaatatatgcaaaagagcggtcttcctcacttagagacatttcccaaggaaaatatgtggcattagtagccgagtttgtcagccgggttaaaaatgagcccaattcaactatctggctcaattgcaatactgttgaagaaaaatgtgaattgatttctcgtgtatcgataacagatacgaaacaatcaatctcgagtacaattgcacagttatttccagaattggattactattactcagaatatgaatatgccaccccagaattgacaaattacttcagacattatcgctatcataaagtcacaaatacgctaactttagactttatcaaattggctgaatctttggccattcctgacatagtgcccgagagagatcaggaactatcacgcttcaaaaatgaaacaaacacagcacttctactcgtagacgggcttggtgcagaatacatccccctgatagtcacagaacttgaaaaaatgagttacaaaatagaactatgtgaagcagtaaaagtgcgtctaccaacatctactgaatttaataaaatcgattggaacaacaacctactgcctgaaataaaaggcattgacaatacagctcataatggagcaataaaaaatgaaaacacctctgtagaacgtaatttttacgagtcactcagagtgataaaggacgaattgttgaatagagtctccaaatccctcagtgattattccaaagtcataataactgccgatcatggaatgtctaggctggcagttttagctaatgagttaaaacttgttcaaaccctcgaatgggaaggtgaacccgatgactggaggtttgctaaagcgcccaatagtcttgccccaccaccagaatttattaaaaaacgtgacgtagaaaacgacacgatatactgggttgttaggggatacaataggttgcctaagtccggtggtaaaaaatacgaattacatgggggagcgtcgattgaagagagtctagttccttttatagttgtatcctccgaatggaatgatagtaaaaactctgaacagtcggttaaatccgaagtaaagaaacctgaacaaatcaaagaaaaagctctattcgctgacctggattgataacatgtatagccctcaaaaactaaaagaaatctttcctgaaacaacagtatacaaagatcaaactatcatggcgatcttcaaagccgaaaaactcgaagccttccttagggattggattctaaaaaggaaagaaaacgaggatggacagattccgagtattgatgaactaagtaagtacatccaaaaaataatcccgcatcgtaatgagaaacagcaattagaggacgaggcaagaaccgagggcataacccgtccctttcttgcaaaaatcaatatcgcatttaatgcaaaagcagactattattgctttgaattacccgatttggggttcacatatactgacacaagaatagaggattatgtttggaacaggattaaaaaagaattaatcgctgaagctggggggtggggtttaatcaaacttggttacaatcctccagaagatggtaaatctggtaaatttaccctattggaatacaataatttttgtccatacgaagttagcttagaggcatacaaagaggccagatcaaaaatcgaagacactgaagagtggatggacatcctccttggtgccatcgactataacgccgaaggtttcgaattgaaaggcaatctggaacaggacacgtggttggcaaaacatactatgttgacacgccttttgccattcgtccaatcaagaattaatctttttgaattggccccacaacaaactggtaaatcctatatctttggtaaagtcagtaaatatggctggctagcaggagggggtagcctcagtcgtgcaaaattattcctggatatgcgccccggtgccaaaactagggggttagtgactttcaatgactatgtagccatagatgaaattaaatccattaaatttaccaatgacaaagaaatggccgggatattgaagggttacatggaagacggttttgttaacgttggaggaacaaaaatcgaaggagatgctgggatgatcttcttgggaaatatcaacgtcaacaggatgatgtctggccaggatatgttcgaagaactccccgaggtattcagagatagcgcattaatacaacgtatacatgggttcataccgggctatttcatacccccgctgtcaccggacatgcgcatgaatggctgggcgcttaatacagagtatttcacagaaattatgcatctgatgagaagccccagtgaaacaatgaagtatcgtggaatggtagaggaactggtactggtcgagtccagagctaaaaatgtatctggtagagaggttgaagcagtaatgaggctgtgtacagcgtatatgaaattatttttccctcacgccaacaatgatctcataaagacaataaaattcaaagaagagttcaacagatactgtttagagccagcagttgctatgcaaaaaacagtactggagcaaatgcagattattaatcctgaagaatttagcaacaaatgtatggcaacatacagagttcgttgaggaattgatttgttattgtgctccagttgtggtgaagaaacaagcaacatttcagttgcactgtgtaaaaaaatattcggtaaaaagactaaacggattctttgtatgagttgtttatcagagcatctcgaattatcagaggaagaattgattgatatggccgaagattttaaaaaacaagggtgcacattgtttgagtgagcaaatgaaatactcaatatacgctgacaatgctgctacaacaaaaatcgaccctgaggcggcagaacaactgtattctattttaacaaatgattactcgaatccttctcaaaaatactcattctccaagaaaatccgcactatcttagacaactctcgaaaagaaatagcacaagcaatcaatgccgatccatgtgaaataatattcacttcgggtggtacagagtcagataactgggcattgcgtggaacgtgtgttccgacatcctccaaaacgacggtgattacatccctatttgaacaccatgctgttttgaaaaacatgaattatctaagaaataatggtgacaaaatcatttatctacacccttcaaaaacgggacatattttctctgaagaattactgtcaaaaatagatcatagcacccgtattgtctctgtaatgatggttaacaacgagcttggcacaattcaacctattaaggacttgtgtaaaattgcccatgattacggtgcattgtttcatactgatgctgttcaggcaatgggtcatatgaatatcgatgttaaagacctcggtgttgatatgctatctgcatcagctcacaaatttaatgggcctaaaggcatcggtttcctctatgttagaaaaggaaccaagcttcattcactaattgttggcggagaacaagaatatggattccgtgcaggcacagaaaatgtcgcgtccattgcggctatgagtaaagccttgattaacaatatagccaacattacgaaaatacaatcacacctagaaatgattgaaagcaccttttacaatgaattgaacaaacgtggtgtaagttaccacatcaactcatgtgctcctaaattaccagggatcatcagtatttcattcaataaaatcactggagaatcccttcaaattcagttagacatcaaagggatatatgtgtccacagggtctgcttgtgatagtcggaatatgcaaatatctcatgttctcaaagcaattaatctagacccctctctcgctaacaataccatcagaatatcatttggaaaatataatacggaaaaagatgcgataaacgtagcaatggcgatagaacaaatagtgagagataacaattgacgaaatggatgatgttattccggcggattgtcgggatcgacatactctatgatgattctactcctcgatgccttttcccgcatagcattgtactcttttgtaaattgactttttgatgtcatatcatcatcacacatctcaatgaacaacatcagtgctacacggcatactttttggatgcgctctacatcatcttcttgaaaaagatacctggataaactgtcaatatactgatatccagcatcacttggtctaattggaatctgttttacgcatggtccaggaaatctttttgtgaatctatggtaacgggaagatccattgttttttaacacttctttgaactcggaatatttttccaacgatgttccttccgcccgttcataatcgtgtaaaagagggagaaattgcctaagaaaagaccaatatgtatcacgaaccgctccatagagaaaatcagtgcgcccactaaaaagacccattttctctatcgtgttgtcgatagcatcccagcactttatgggtacgctaatgtttagtctgtcttggtaatattcagacattttatttttcctatcacatagtactaagcagaaaaattataaataaaatatcacgcttattcaatataactacgcatattgcatagttaggagcaaatagtatggcgaaaaccatcgtgagttgcggattctcccaaacggagatcgatacgattgacaatctggtcaagaaaggctattttgccagtcgttccgatgcaatccgcacgtgtacgaacgaatgcctcgtcaggagcctaaatctgcggtttgtagtactacaacgatgtaaccatacagattgttgattcttctttatatgcggtatttaaagaatatataaagaaaggtattatatatgtaaccttacatataggttactaatgggaagcatattctatatggaacgcaacggccagaagtacgcctacgaaagtacctctgtcagggtaccgggaaggaaaaatccgaaaactatcaagacgtacctgggcagggtggacccggagacgggtaagatcattcctaaagagtcgaggagccgtcccaaggaggaatatgcgaagcattacgggtccgtcaggttccttgacggcatacagaaggacatgggcatcttcgaggacctggatgaggtgttcaccgccttggcacccaacatcatgggtgccgccatggccctggcgatcaatcccacctccatggattcgatccactatacggtggagaacaccgtgatcagggagaccatgaagcttagaggaacattatctccgagcactatgggtaccgtctgcgaggatgtcgggggaatgatgaacaccatggacagattcttcacgagacgcatagccagatcctccagcgggttcttctccctcgatttgacatcggtatcaacctattccaagatggggggatgggcacagtggggacacaaccgcgacggagaggatctgaaacagaccaacatagccatggtcaccgatggcgatgggattccggtcatgttccgtatgctccccgggagcattgctgacatggcggtgatgaaggacaccgtccgtgatatgaaaggacatgggctgcaagggaaggatggtcatggacagaggattcgagagtgcgaccaacgtatccgctctgatggatctggatatggatttcaccatgccttcgaacgtgaaagctgagccgatcaagaagctgatgtccaaagcgatagacgaactgaaggcatcgtcctcgttcgcctttccacgaggggaaggcgtacaagtatgcggagtatgaggttggggtgatcgataccgaagacggatacgggtatatcgtcgaggtccccaggaaccacagggattctgccgcagtgaacgagagattcgcaaaagccaggaaactgaaggcattcgtggtgttcgatccctcgaaggcatccgacgacatcacgaagatgatgtccatggtgtctgagacggagatgaggctggagaacaccaaacaccgcgatcccgaactgacgtacaggaaactgccgccgttcgtaaggaggtatttggactacacggtcgacgatgatgggtacatgcacatcgagaggaagcagaacgcgttcacattcgcagacaacagggccgggatgttcgtgatgctggcttcctcaggtacgacattcgatcagatgatgacctcctacgatgtgagggattgggtggagaaggccttcgacgtatacaagaacgaactggaaggggacaggaacaacaccggcaatccggaacgcgccagaggacggctgttcataaagttcatagcgctgatgatgaggatacgcatccagaatgttttgagggaccacgaccgggatgtgctgcggaccaaggcgaagaaggattctgtcaacgggatgtcggtgagcgaactcctcctgtcgctgaatacggtgttcgccatcggcaacacgggcgactggaggctcacgcacatatcgaagaacatcagagagatattcagcgtcttcggactggagcagatggaatcgggccagatcgttctgggatgatgtaacctatacaatccgcagatttaggtcaggaggggactcgtatgattcccctttcctcgatggggaaacgcggaccgatcctctgcggaaaggtcccgccggaactgtacgagagtgccaagaagatgatcgatggtgaggagttcaagactctgaacgatatcgtcgaaacagcagtctggcacttggtgaacgacagggagaaatcggaaggaatcgaagggggcgaaagcgttgcaaactgaggccctctccgcatcctccaagaggcctactgccgatagaactattaatggtttcgacggaaagaacgggtcatccaccaacccacctagcagcagagtgaagatgtacatcggagtctgcaaatggtgcaaggaatggagagaactcgtccacaccaggaactattgggacgatgagatcagaatctgcacggattgtctcaaaaaccccatcggacacaaggggagggcaatctgatgtccaagaacgtccgtaccccagatagctgcatcaaagaattccttgatacgaagttcagaggtggcaagccatacacgaaggacaaatgcagatggagtctccagcgctccaagagaatcttggaagaaggcggtttcgatgcatccccctacagaatcaatgctgatgctgtcgagtacatactcgaataccaccgttctaacggaaaactcgatacgtacatcaagggagagatcgcttatctcaacagatatctcaagttcttcaagaatgaagtcatcaaagacatgggcatcagattctctgctgatatgagagtcaatgcacactggttggaggaggaccaatatcaggcactcatgaatgtcgagaaaacccctctccaggaaatggtcatccatcttgaactccgcatggggctgaggaacgcagagtgctgtcgtatcacattggatgacatcaacttcaaaagaaacggcccctacatcaacgtcaaaggaaagggcaggggagacggcaagtacaggtccgtaagcttcaatgttgagaccagagaggttatcgacaggtggatggaagaaagggcaaaaatcgtcaagattgcccaagagaacatcccttattggaaggacccgggatatcttctcctatggtgccattacaagaatcacccagaggtcggatactataaggaacacactggcagtcttgacgatgcggtccttgatcctctgagggaaaagctaggttttcacttctgcaatcatgatctcagaaggacctttggtcgcagactcttccttgctggtgtcgacatagaaacggttgccaaattcctcggtcacgagtcgaccgttgagtccttgagatacatcggagtcaacctcgacgatatggagaagggaatggagcttctcagaaagtacgatgccaagatgggggtcaacaaggcttaatccaattcaatgtccaaggtctttcaattcacggaagactctggacaccgttttggacccggttatttctgttactggcaggtgattattatggacctcggtgaggagacaaaagacgagtggcataccctttaccccttttttggggttcttggggagggtatccagatattgtggtacaagtaaaatcggaaagtgcggatccgcattcggcaatccgatatgatgcggtcataccctctcggaacgtgccgccttataggaatccccatacgacttcgccttcacacccatccacatgcacagcggaacgagtacggctacgaaaacagggaacagccacggctcgaaggaatagtccaagatgtatatgacatcggatatgttcccgatgatcagccattggatgaaatatatcgcggtgagactgtatgatacgcgtgtcaccgccgaaatgaccctgtcccctgtcggaacgccccggatcctggacatcaggaagtagagcaaggacagttccgtcatgacccagaacaaggagaatatcgtcttgaggatatcctgattatagtaggaatccaccatgtagaagtccctcacatcgatacccgccgaaacgcatatcaccgtgaccaggacgaaggtcgcggccgatacggccaggatcttggagtataaggccctgtgatcggaacagcacacgaggatatccgagaaaacgatccccgccacagggaagatgaaccaattcagaagaggaaacgcggattccgggaactccatcttgacgaacagacccaggagaccgtccacggcaggatttcccgtacacgtgccggccaggacataacccagggcctgcatcgccaatgcgatgatcaacatacccagatgggagaccttcagcttctccaatacgccgatgagcatgaaacccatccctgcgaaatgcaatatgtccactatgaacaccagttcgatgacgtcgtccgcggagaccgtcggatagcccatgaagtatccgatggacatggcgatccatccgttgagggcgttcaacagatatcccatcatcagaaggatgaatcccctccttatgtgatcggcaggaccccttctcctgctgaacatgaccgtcacgcccatgcagaacatgaaggcaggtgcggcggcgggacctcccaggaaaaagaccgcgttgttgaccgcggccccgtaatctccgggagagaaattgaactcgaagatatggaccgttatcatgaacacgatcgcaaagaacttcatcgcatcgagttcgacgacacgtctcttactctgggtctccgacacggatgtccatcggatcccggatatatagaaaatgtcttatcccgaatcctgcggatgggatcgagggccgccacagaccttcggaccggatccatccgaatatgaagaagccgtccagaggcatggatcgacggaaaccatgcgaaaaatcgatgaaagtctccgagaacgatccatgctaatgaaattattgaattttccgtacgtataattcaatttgatgtgaattttccgtacggaaaaatcataatgattatatccgtacaactgctccgaccagtatgctcaggagaaaagcctacgatgccctcatggaatggaaagggaggcctcacaaacctctgctggtgaaggggcagagacaggtcgggaagacattcatcatcgaggctttcgccaaaaagaactacgcatacttcgtcaacatagatttccgttcggataaggatgccaggaaggtgttctccgggaatctcgatgtggattccatgataaggggcttggagatcctatacccggatgccgtcttcgaacctggttcgacgcttatactgttcgatgagatacaggattgtcctcaggcatattcgtcactgaagtattttgcattggacggccggtatgacgtcatcggcagcggctcactcctgggagtagctttgaacagggccgagaaagaagaacggatggacgatattccttccgttcccgtgggattcacggaacatctgaccatgtattccctggatttcgaggagttcttgtgggccaaggggatcaagaaagaacacatcgatggattaaggacatgcatccgcgagaggaggtctgtccccgatgccgtacattccgcattctcatcctatttcagggaatatatgatcgtgggaggaatgccagaggtcgtccaggactatatggatacgaagaaactcggcggggccatcaatatacaggatcgcttgttggatgatatcgtagccgacatcaacaaatacaataccccgatcaacgccgccaagacgcgggaatgtttcgattccataccgggacagttggctgaatccaacaagaagttcatgtattccagagtggacgggggagaatccaggaattccgcccagagatattcggagaatcttctgtggataaagaatgcgggatacgggaacttctgttacagggtctcctcggtggagaccccgttgagtgcccgcgaggagagcggtcatttcaagatctatctctcggacacagggcttctgatcgggatgtacggacagagcgtccgtaaagcggtggccatgggggacagccgtgtgaatctcggcgccgtcgcggagaacgtcgtggcggaatgcatggtcaagtgcggcatagagccgagatactacagcaagaacaaaggcgagaacaggatggaactggatttcgtggcggagatcggcgatgatctttccgtcatagaagtcaaatcgggaaagagccgtgaagccccgtcgctgtcgaaagtaccttccatcttcaaggtcgacaggaggattatgttcgaggacaccaacatccgcatttcggatgatggtgtggaacattatccgctgtatgcggcggccttcatggattccatgggcgatacccgggatatcgacgacctcctttggacggaacctgtggaccgggatgcggatacagacgcaccggaaacgaatctgccgggatgtgaccgattcgatttataagcggagatggcaacgcatgcccatgaagggagaggtttcacggaaatacatacccatcggagtggacgatttcaaggagatccgtgatgggaatcactatttcatatcgactaggaattgatacggatcgaatcttctgcatcggttattatttaagtctgattacagatgaaatattgcgggtcgccccttcggcgactcagtggggggatcgtggtccctcgaccactcacccctacatccttctgcgattcactgtcggttcgggaatatcttcagcccgtaaccttctgatctggacctgttcttgagaatcttcggctctataatcgaataaggggaagggattactccctcctcctcttctaagaaccgtgcgtgcgactttcaccgcacacggctcaagccaacgacaacccattgttaccgggcgacttacatagcgaaactcttatccctatatacccgcgttcatacttcctgttattctgtttgtcgtggaagtattccgtgtcgatgtagggattcttcgtaccgattaccttcacgtggtgttttatcttcacatccatcggtccgaatagctcttccttgtcggaacagaacgtccatttcctgcttcctctctggtgccaatacctgtccttcacccatctcttccctttcttcctgtgtttcctcagtccccatctgtacagtgtctggaacagacgggaatcgagatagcagaatgtcctggaggacatggctgatttgtggtagttgcaccatccgcgaatcttcggattcagttcacggatcaactcatcctgacccttcgcctttcccttcaccaatacggtctccttgatcgaggccttcatcgattgcagggatttgttcgaagatctgattatgagtatcctccttccttgattgcgatgtttcctgaagttccatccgaggaaatcgaacccatcgtctatgtgggtgatgagggtcttctcctcggacagttccaatcctctttccttgaggaatgtggagagcagtttcttgaccgcttccgttcccaattgcccgagtaatgggaaaaacaggggagtccgaaccgagaggtcaagaggtttcaatcgatcattctgtttcgaatattgcataaccaagaactaccaagggaagtcagcttttaccatcaccctgtttttttgcggttcataagatagatatatacgcggtgcgggaggggatcaacttccttccctcgagtctggctagtcgatttcgagggaagtcgaattgttcgaggatttcgacctattccacgaaaatattatctcaatccgtatcgatgtttcgcccatgtccgaagatcccctgacgtcatacatcaaaaacggaagcgaaaggtgtcagctcgcattgaccgatcattcgtaccgcaccaaacatcagcgggagtccaaagacaatgcagtggttcagatcaacttcgagttaggggcattaggggatgcagtcctgcgtctggcactgacccagatcctctatcatgaaggcagggagaaacttatagaggaacgtgcgagatacgagtccgatagagttcttgtcgagagagtcaccccttattacaggctgagggatgtattacgttacgacgatacgaacaaggataagatgcatggttatgactattttgaatactctggtgaaggcgatcatccgcagaagttcctcgctaccgcgatggaggcactactgggagcatacttcctcgaccacagagaatcgatatctgaagtgattccgattgtcaggaactggatgtcggtcatcgacaaggactatgtatgcatcgatacggaacgcagcacaggcggtaatgacaggtcgctacccatagaagaacggaaatgttccataatcgagattgccgcaatcaaggttgtagacggtcggccagaagagaaatactgggatgtgcaactgattccgggccgttgttttgattcctacgcattaaatgttctgcatagagatcccgacagatatgccaaaggaaaggatcccgaaacggctttggctgagctgatcaaatttgtcggtcatctgcctgtccttggttgcgatttcgtcgacaaagatctgtactacatcaacgagcatctcgaatgtttcaaacacgacaagtggaaaccggatgtcatcgagttacagaacaggtgcggtaaaaccaaacttgaatacatgtgccagaggttcggtatcagcttcattcagacacattctgcgattgatgatgcacgtgtaaccgtcgaatgtttcgagagtttgaatagtaagggtatttgaaaagaagtttgctgactgtacagattaatgtcgcgaagttgaacaccttagtcggggcccccgtccttgtggaatccatgatgaacaatctctccacggggagcagtctcttaggcaatgaatcggttttcgaataaatgaactatgaaagaagtcaaaactctctacactcttgaatgattttctgcggaaatttacccgcgtatgttgctgtaccgactcacctaatagctcataccattgggaaaaatacgcatgtggtggaacaggtgcgtgtctttgtttcaaatccgaggacattcaccgggaggtacgcaaaatatcatatgagcctcgtacggatgtggatccaacacagcaactatccaaattactacatttaaattatgctggaaccaaactaattgataagaaaatacctacaaaacaagaagttttgaggtatacttgcactttgaagggacaattgattgaacggttattcagcaggtctgcaatattcaaaggtgaggcaatacatctcgataaagaatggcattatattacatttggaaaggtatccgagcttgatacacaggggaaagaacagttcttcgataaattatggggacaatttcaagcggtttatcttggccctaatgtaagtgaagcggataaatcaaaggttattgaagtatgtgaaaaatactccatcccaatattttacggacaaaccactcagctttgacaatgaataataacaatttgattgcacagatttgtatattattataaatttgtgaagtaagataatgaatctatcaccgagcgtaaagaaggcatcagtgtggcaacaacatatctatgtatcgatttcggagcaaatcgtaatgccgtcaggaacaagacgattttctccaacaatctggaggatcagttctccaatcttgtacaatacaaggggtgggatttcgaggatttcgtaagatcctgcttccttctggaaaactctgatgttttcgtttcatatcctaatttcaacagggaaccatataccaaggaaatgggtagggatggagacaagttcaccatcacctactacaacaatgtcgcaatacgtttcccccagggtaagaaagagaacgatcttgtcctgatgggagacatcatggagaagagcaacggtcacaggatcttcaatgtgaaagccatcctgaccgtaagccccaacgtggtccattacggggagcttcagttgaactgttcgattgtcctgaagcttcaggacaaaggcaactgggaaaccgcaggggactgggaaggtcctaaacccagctgggaccacatcaacaacagttcattgacgaacgatttcatgctaaaactgaaccaacaatatgttgttcccgatgcggagaaagttttcaatgaactgaacgaatggaacaattatctggaatccagattttatcttataaagactgacgaagccaaaggttacgaactcggtgaatgcgtgccggatgtgttcaaggcatacaccaccggaggcaaagtcgatgtcgaagaatacgggaggatccaatacctcaacggcaagcagacctccgcatggactctcgagagtgtgaatgataccagtagggaagccatcctgatgcacatatacgttgactgtcaggaaaaggcataccttgccaagaaagacgaaaaggtcaacgagaaaaagcggttcgacggattcacccgttctccgctagtattggtggatccgagtgtcaaggctgataagttcggccctcagggcctgagtatcagggagaaaagaatcgaagcctcctattatgaaaccgtggagcccgtcgaggaactcacggaacttgatcgtgaatgcgaacaacgtattgtcaaactgaaagcggatcaggaaaaagcctacatgtccgaggtgtcttcgaagctcaacacattcaagactactgtccttccgaagaaggctgcagaataccgtggaggacagagtgaatctgtaaggaaccgcatcaccctcgaatgcgaaacccagatatcaagtgaaaccgaaagaatcgacagtcaatacacatcccgcaagaatgagcagagttcaatcagatcggaaataagtgagaagaggtctgcccacttgggtaccaacaaagtgcttctcgaagtcaaggaacaatttgccacattaacaaaagatcgttcacccaaggaactccgcaattatttggaagatctcaggaaaaaggtcaaggaggagaaacatccggacaaatccatggtcggggaaatcgaacagattgaatccgtactgagtaaaatcgatgaccttcagaaaaacatcaatgcactagacaaaagtgtcagggcgtccgaatccgagttgggtaaacttgaattgaaactgaagtcactatctgactcccttactgcattagacaatgaaaagaaagcacttccagacaagtatgatcctgaacctctgatacagaatgaattggatcgtcttgaaaagcagttccgggaacagatgctggaagaagaggaaagcagactcagaaccttgcttcgccccgagtatgacctgcgtattagtagaggaacaaccgacatcaaggtggagatcgacaccagaaaggacaatgcgaagaccgaacacaacatcgcaaggttccatgtctatttcgaactagaagtgcccgagaatgaaaatcttgaagcaaatctgaagagtttctcgaaataccagaagcctggtctgattctccgcaaggactattttggagacaaggtgttgctgaaacgtcagcaggaagctctcaactacctaatgaacggatatgttctcaatccattccttgccacattcctgttcagtcccaaggcaagggggaaatctgttgttagccgtatcgaccatttcttcagtgacacactcaatgactcgcagaaagaggcagtagaaaaggcactgtcctccaatggattgttcctcatccaggggcctcctggaaccggaaagacccaggtcatcgctgaaatcaccgctcagcttgcggcaagtggtaggaaggtgctgattgccagccagaataacaaagctgtcgacaatgcgttcagcaggatacccaagattccgatggttcgccccatgcgcatcctttcggaaaatgcaaacaagcagaagaatccctattccatggcagcactcttgtccaatttctatacaaatctttcagacagcatggagtctgaagtttcgaagtacgagcatcgtcagaaattcgagaaagaacttgatggctatatcgatgaactcaagggacttctcgatgaaatctcgaaactcgaaaatgaaaccgaggaggtaaacagcaagatccgtaaggccgatgcggatctccaggccgaatatgctgaaagagaccgtatcgagaacagtaatttcaacatggaggacaaacaggagcagaaggacaacgagatagaatccatccttgaattcgaagacgacaagttccttgcaaagatcctgcgtgagctcggcgaactcggtttcagtccttccgattacggaaacgatcgttctgtcctcaagtccatgtatgccactgcatacgaggacatagtgtccgaatattcgaaacgcatcgaacacatggattacttcgaactgaagaaggaaaagtccgaagcgtctgcaccgaacgagatcgcacgcatcaacaaggaaatgaagtactactgtgaggacaacgatttctccgaaaaggaagaattcccgttcttaagcagtcttgtctccgttccggacaaaggcatactactggaatgtaaaaagcatctcgataccatcatgggtaagaaggtatcttcactccgtgccgcaaaagaagctctttccgaagacaaacaggacctgtccggagtaaaggctgaaatcgcacgcctcaaggaaaggatcgaatccctgaagaaggatgccgcctaccaacgtctttcggatgccgagaagagattcgacacgaaagccaaggagatctttgtgaaacttcgtatcggtacactgtggaaaacacgtgcggatgccatatccgaattgaaacgtgagaagagacgtatcgaagatgagttcagcagcaaccacgacgaggttgaggaacgtgttaaggcctatcgtcgtatgagcaagtatctgtcttcggaggaagttatcaagaaggacagtgaaacttatgtccaagtgcttctcaagacggtgaatgtcatcggtatgacctgttccgccaaggccaacttcaaggataacgccgagaacaacatcatgttgaacgagatgaacatagacgtagtcattgtggatgaggtcagcaaggttcccttcgtagagatccttcagccaatcctgttcggaaagaccgtcattctcgtaggtgaccacaaacagctgcctccgatgttcgacaggcgtcttaacgatggagaagagaacagttacgaccccagattcatcaatcctgaaaaagaagagatgtacaagagcatgtatgagcactcgttcttcgccaagctcttcgatgattctcctgaatccatgaagtcacctttgaggatacagtaccgcatgcatccccacatcatggatgtcgacaacgtgttctacgggggcgacctggtgttcggcggaaacgaggcagataaggagcactatctagagatttacggggcttccggaaagaggatcatcggtagggacaaccacgtggtcttcgtcaatgtcgagggtaaggaaaagaaagaggcgggaagcacatcgtacaccaatcccgaagaggtccgtacggtcaggaaacttctggaactgatcaacaagaactgccgtctggatcgcaagggtcagaaactgctgcctgagtaccgttcccgtaatgatgaacgtctcagtgtgggtgtcatctgcccatacgctgatcaggcaaaagagatacgtaagaacaaggaaaagtaccgttcgtttaacgatcgtcccgatgagaaattcatggtcaagtccgtggatgatttccagggagatgaacgcgacatcatcatcctgtccatggtcagaaccaagaaatcagattttctcagggatttccgccgtatcaacgtcgcaatcagtagggccaggtgcctgttgatcatagttggaaacaggaaggctctcgaatccatgaacgtgatgctcgacggtacttccgttcccgtgtaccgcaatatgatccgtgctatcgagaggaagaacggtgtcctccagcagaacgcaataacaggaggtgaatgaatgtcgaaattcactgtaaaagtcaaactgcctgcaatcttatgcgatttcaaggcttcttacagtcatgttgacaaactcagcggagtccagtacatgatcctgacaatcgtaagcacagattcattcaaggagcttacatggggggagatgatggataggttgggtatccccgagataatctataacgagatgtacaaacctgccatcggcaggatgatcttgttgaagatggtcgagcccaccggaaggatagatcttgacgattatgtgggtgagaccgttctgacaaaaatgggaaggcaggcttatgagaaaggagtcatggcacaggatgtggatgatttctcaggaactgttgcaaacactcctgccgcacccagtaacaagtatgtcaaaggatccaccctcaaggtctgtgacaagactgggttcattgaggataggttctccgatctcgaaccggatgaactcaagattgagaatcatattatcaaggagaagtcccaatacggtgtcgacgaagctgatgccgatgtgttcgatatcagaatagagaggcagaaggaccttgcatgttaccagagggatctgcgcgtaggtcttgatgaggtgaccgggcagttcaccatcgaaagtgataacctcgatgataatttcctgaaatcaaggttcaactctcccgaactcctatcggaaatacctgaacagataagtcagtcctcgtcagccgagatcagatacgtagcttgggcagacaaggttcccgattgggagaatgtgaggttcttccttccgtttgatgtgaaattcgataagtccaaattggtgctggtaaacggaaagaactgcaggtcctcgaaatacctatgttcggagatcaccggtgattcagatatagtagttatcgaaacctccaatctggggtatgagtacgcacttgtagagattccgacagtcatagaaggcttcgaaggcgaatcaaaatgcaagttgatggtccgtcgcagtatcgatgagaaacgtatcgccgagtacattgaaactgccgcaagaagcatcgatcctgttgacactgaatctcttgccaaagcattgggaatatgcgacatcatcgctgataaaagactctcgaaggagattgtaggcaactgcctacgcaagacgtccaatttccagggtacccttatcgaactccagcagtacaagaaagccaaatggtacagtgaacttccagatatggtagaggaagccattcttgaaaaggaatccgatgcaaaacaggttgccacagtactgaatcaggcaaatcttcagattgctggcacattagcagcttcgaggttcaaatccgaagatccatcaattgcactttcccatgcagacatccttgcaccggtagtcaggaatgatgtaacgttcctacgtgatatgggcctggagcagacaatagccgacatgatcctcgacggagatgctcccccatattcatcgaagcacctagcatcgatgtccaatctgtcccgcaatctgcatgaactcaagaaagttttccatatcgaatctccgtcgaagtacacattcgatctgagtgagatgaaatcagaagagaaggaacgtctgaagtcctatctttccacttatggaaaggatatggataccatccgtacattgatccagggtacaggcagttattccgaactgaaagcatacgaatccttcttcaaggagatggttcagttcatcaatcccggcaacggttctgatctgagaacctatggaatcgaggaaggcatcagactatccgagacactggaaaaactcggcttgagcggaactctggatgagatgatctccgatgctcatgacaagcacatcatcagtgacaatgatcatgcgatactcaccgaattcaggctgttcaggaatgaatgtgcccaccagatggttgtcggtgaggtcaaaaagaacaaactgaaacagtggaaacaggcaatagataatctttcacgcagagaaaacaagggggaaaagaaggaatgagccaccaggaacaggctaccctcgaatatgcaggggcttgcaaacagatgttggatgaggcacagaagcagcttcagcagatactggaaagtgcaaaggcgaccgttgaaggttcttcttccctaatggattccacattggaatccatgatgggagacctttctgaatcagcaacggaaatgatgaggtcgatctcgcaacgcagggactccatgggttcgactgcataccgtatcgaaatcgacagcacccgtcaattcctgtctgcagtcaactccgtggtgctgaagtccaatgcactccagactgccatcaggggtgcgtttatcagtaaaatggagagccacacccagtacatcaatggtcttgatgaatatcttgcaagtattacagacgagaaactccgtaagatgatcggattgcttgcacgtaacaaggctcacaaagacctgtccctcgaagagctccgcgaacttgccgagagcaaactggatccttcgaagaaagtacgtcgcaagctcgttaacgacaccgttatagaagtacgtgagaggatggttgcggagaaggtttccgcagaaaacatagaaaaggtttcaagtgtaaccgaggaggtcagcccgttggaaataatggattccgccaccacggagatatttgacgagaggttacgcagatctgcggtacaggctattgtcaaaagtatttctgcaaagggattcatcgtgaagaaggagaatatccgccacatcaaggaaacagatactgtgaagatcaccgccatgaaacctgggggacagaaggcggaattctccatcgatctgactggcaaattcatgtaccatttccaagggtacgaggggcaggcatgtcagaaagacatctcgcctctggaaagagatctggaagaggtatatggtatcaaactcaccgacaagaagaccatatgggataaccccgataaactaacacaatcgcatcatgcagagatgaaggtaaggggggacagctgatgtcaatcacaaacgcattcaacaggataaagcgtgaagcaggaatcaaaagatgcataatcgttgaaggtaacgtcagcgacatctacctcatcgaccgcgaactgatggagatcaaaggttcactgaacagaatgctcggagaatgcgggtacaccgatatcgtgacctgggatcgtatcgcaggcatccagggggatgtcaaatccctggttctgacggaggaaccagaacagcaggatggagatgattacgatctcggcgatgttgaaatcccggaaaccacagcaacaggggcctgcaaggatctcggagacatgttcgctctagtccaccgcacaatgtcggaccccgaaaagcacactgcattcatccttgattggtccgaatacctattctctaccggaggacagttggatccccaggacagacagtacctcaccctgctgggcaaggcacttagggacaatattccccgttaccgcagcaaggaaagacaatcaactgtcatcatcgttgcaaacaaagcttcgatgcttccattgtcgttctattcaggaaatcccgaagtaagtatcataacactcaccaaaccagacatggacgaacgcaggtcgatgctgaagaaggtcgctaccggattccttctgaaggacgaggatgacatctccgacagcaggaagttcgaggattatgtcgatatgctgaacgatttcaccaaccgtgagatcatccagatggccaacatgtcccgtactgaggagaccatgaccttcgagaaactattctacctcttcagatacggggagaaggagaatccctgggagaaacttgacccagagaaggtcaagaagatgaagaagatcctccgtgaaagagtgatcggtcaagatcaggccatcgatcatgtatttgataccatcgtaaaagcattcatgggtgtcaccggaatgcacaagtcctccagcagatcgatgcccaagggagttttcttcttcgtcggacctaccggagtcggaaaaaccgagctgtcgaaggcacttgcaaagttccttttcggtgacgaatccgcatgcatccgtttcgatatgtctgaatacagccaggagaacagcgaccagaagctgatcggtgcacctccggggtatgtcggattcgaggagggtggacagcttaccaatgccatccgtgagaagcctttcagtgtcgtgctgttcgacgagatcgagaaggcggccaagcctaaccctcgcatccttgacatcttcctgcagatcctcgaggacggaaggctgactgataacaggggagagaccacttatttctccgacacggtcatcatcttcacctcgaatctcggagcaagcgaggtccagaacagttctgacagtgcccgcgtatcagaggagttcacacatatcgtcaaggattacttcgacaacgaactgaagaggcctgagatcctcggaaggattggttacgagaacatcgtgcccttcaacttcatcaacgatccctcgtttgcacagaacatcctcaaatcgaagatcaaacccgtgcagatcggaatcagagagaaatacggaatcgaactgaaaatccgcaatgaacagagcttctgtgattatatcctcgccggtgcggatgttgccaagggcggtagggacatcctcaatgccctggactcccgtctgctgacacctcttgcaaaacatctcttcgataactacgaagacctcgacaggatgaagggtgccgtgctgtatgcaatcgtaaaggacgatgaccttgaattcgaattcgactgaaccgatttacaacgtggcctcggtgaaattatgcaccgaggccctgggaccatacaaacgtatggcgatatggttccaaggatgtaccttcaactgcagggggtgctgcaatcccgaactccaaccactcgaaccaagaaatctcgtcagcttaacagaactgttggattccgctcagaaatcgaaggcagataatggtatcgagggcgtgaccttcatcggcggagaaccgacattgcaaaggaatctttcggttctagccaaagggataaaggatctcggattggggatccttatgttcaccggcagagatgttgaggatcttcagaaggatctgatagaacatctagatttggtgatcgatggaaggttcgaggtcgaagaccgtgattatgaaaggaatctgataggttcgcacaatcagagaatcatcaatctgagtggacgttatgcagatcatattgattggtttacaaagacacgttccgattacatagaagtagatattctggacgactctttcataacgaacgggagtgccttctgaaatttctgtttcgaattttccgagattgacaaacttttatacttattggcaatagcagggattccccaatgggcgggtgaagaacaaaacccgaacttctgatcattttgctctctgagcatcttagtactgtggacgggaaaccgttctttgaatcctaaattctcggattttatggctacatcaggataatgaaatccgaccacttttgggttcatcgagaccgaaaagacggaatgcttcccttgcacctttgctgatgtgagacagtctccagtttcctttgaagccgatggcggaaacagttgacagggtgcggaagagttcgtcaacggtcttgccgttgacggaatccttcctgttcttggtacgcagggtctccttgtcatgatccctcaggatgttctgcacctcgatcctcatgatcatcgcaatgaacttgatgaacaggcgaccgcgggccgaatccggattcccggtacgggacctggacccgtccaggtccgtcttgtagacatcaaatgccttctccacccagtccctgacatcgtacgatgacatcatctgctcccaggtggtaccttcagaagcgaacatcacgaagtatccggcacggttgtcggcaaaggtgaacgagttctgcttcctttcgatgtgcatgaaaccttcttcgtcgacagaatagtccacatacctcctcacaaaggcaggcagtttggaatagacctttgcaggatcacgtggtttcgtattctcgtattttagttcgatatcggaaaccatctccataaccgcatcaaggtcgttggaagctttcttgggatcaaagacgacgaatgccctgaacttcctggatgttgcgaaacggctgtcgatcgctgcagaatccttgtggttgcggggaacttcgacgatatattcatcctttccgtcgactgacaccacaccgacctcgtattcggccaccttgtaggtattcccttcatggaatctgaacgcttcagagcttttcatgtcggaagctgctcttgtgagcagcttcttgatcggttcctccctgatgttggaaggcatggtgaacagcacattcctctgaagcagcgagttaacattgtgtgcgttctcgaaacctctatccatcacgaaccttccggagcatccgaggtcctcgagatattccacggtgctttcaagcaccgtggagtcggctatcgatccgggtaacatcgagaacaccatcggtatgcccctcccatcggttacgagtgcgatccccgtctgtctgagatcctctccatcacggttgtgtccccattccgaataacctttcatgtccgaataagaagaaaccgaggtcagatcgagaatcagtttcccatctacggaccttttcacgcgctgcgtgaagaaatgatccatcgaactcagcctctgtccgagttccttggaaagttcgctcattgctgcagacgacaggtttccgcggagcttgtaaagctccgctatggtgctgccatcgattatgtattcgatatccgagaacggggttgcctccagacattgcgagattgctgcggccatgatcttttccgcgatgtccggaaaacaggctttgagatcttcgaaaagtccgagatcatcctgcaccttgtccaatacagcgatgctcccgtagtccttgacatactcctctttcggaggagtcctgttctctttaggaatgatgtttcctgtctcgggatcgactttgcccaagtatatcttctctgtaacgggtgatttcttgcctggaaccctctttgaagtgctctggtaggcatatttgttcccgttgcgttcgatatagtaaatactgggcatagtaggtatatgtatggctacatatttataccttcttctttataaatcatttatatacagtatataaaaagaaaagatcagaaaatcagtgtagtaccacaaatcgaaaatttaggtttgaataacaaaaacctgctacctttccgatttcggaaagaagaagtcctctgaacggtgacatctgttgccggcgaggaggcgttacgactcattcgaagcccgagtgtgacagttagagcgtaatgcaatcccgagtcggttttgttttctcggattactggcaaagaatcataagtggtcacgggatgttcgaagtgaccaaaccccaaacaggccccgtggccgtctttcctgtatgtttgcaagaacataaaggtacggtttccgggacctgaggtttggcgggaaaaggataccgtttgaccaattacaggaacaagatacacgcaaagataccggaaccgaacgataacgtcaccatgaccatgggcaacaagaccgtggtggatgccgtgttcgcggacacgggattggatgtctttctcgacggattgaagagggttcagggcaattcggtggctgccgaaacggcagcattggtggccaattccgtggagatgacaggaatctccgtaaacaggatcgacaggatcctcgaagaggatgcggtgagggaggaatacggtctggatgccaatgcacccagatccatctaccgtacgatagagcggatcggggagaattccgacgccatcgtgagatatctcggggacgtcctgaagaagaagtacggcgtgaaaatggacaccgtcttcatggattggacgtcgctgttcttcgaggcacctcagcagggtatcgtcagggtaggttattcgagggaccacagaccggacagaccccaggtgacgataggcctgagcatggatcgtgagtcgggcatgcccataggattgaccgtgaacgcagggaacatactggatgtcacgcatttcgaggacaccttcgaacagatcaggcatcttctgccgaaggatgctatgatcgttttcgacaacggcgcttattcgagaaagaactcggccctcctggacaaggaaggagtgggattcgtcacaagactgcagctgaatgcttcggacgataagttcgtcggttcccataaagaggattggatcccgatagatggcaccatctcgtatcagatgatcgagggcaatctgaagcgcaggaggtacatcttcaggaacgagaagctgaaagccgatgtgctggcgagatgcagacgcaaagcggaacgcgactgggaggagatggagataatccggaagaacatagattccggaaagaaaccgcgtaagaagtaccggaattccaactgtttcgtcgatacaaagctctcgtaccagttcccgctggacaacagaacgaaggaagaggcgatagacgaggccgttaaccgcatgatcacgggccgcgagggattattcgtgctcctgacgaaccgtccgttgacagctgagaagaccatcgaactgtaccgtgcgaggaatcatgtggagggggctttcagggacctgaagcacgggatcgactggaggccggccagatgtacgaacgagatggcgatcaagggaaggatcctcatcagtttccttgcacttttctgcatctccatggtacgtttcctgcatccggaataccggaaccgtacggcggaatccatatgcgaggaactgggctcgttctcacttacggttctggtgaagggtgatgagcccaagaggaggattttcagcaatttcacgtccctgatcaggcttctgagagcaaggatcaagggcaaaatcaggggattaagggcagatcagacctctctcgacaccttctgatcccgtttccccgtaagtggaaacaagggaagcacatgcgcataaggggcaatctcagcggaagctaggtcgattatctggcataagtgtcaaagtcgggtcgtatcgatcaaatagagatcgggatcgaagatgtcgccgcttttgtgcatgacatcccccgggggaagatcgaaaaggaccttggggtctgactcgacatcacatatgttggaaggatgtgccagatgtctcgtcagctccatgttcattacggataccgcaagataccctccgatctcacaacatgatgcaagagtctccacgatcgcctcgttatcagaatcatcggggaaggaaccgatgacatcgtacagacacagcacgatatcgaaagtcctgtcgggacgataatccctcagatcggacacttcgaattcgacgttggagagtccgtctttcttggacaatgccgacgatatgttggcttccgaataatccacgcccagaatcgaggaggagggatatttcttcgctatcgacagagaatgacgacctcttccgcaaccggcatccattatcctctttccaatgaaggtggaacacagggattccagtgattcgatctccttcgatgcatgtcttgcccacggatggttctccatatccatcctcccatatgcatccttgagacggtcctcggagaaaccgatcgattccactgttggtttggaacgatgttccatgattctgtccatgcgatcaaagccattcaaacactgagattgcaagtatatggtggttttttattacatcctcttaaatccgcgtaggatccactgtcctatggatttgaacccgtagcgtatggtctccatcggatgacgatatacgctgtgtgcggtcgccttgctttccatgatggcggcgacgacctcctgccacgtcccgagaccgtccggaagggtcacgttgccccagcctatacgtccgggcgaatgggcgtccgagcctgccgttatcggtttcccgatcctctcggcgagcttcatggaccttctgttggcgcttttgacggagcgtgcgttcagcgcctccgtcccgtcgaaatcgtacttcagggtgttcttctcccccagacccgaccaccacctgtacgggtgggcggcgaatgcgaaccctcccgcctcgtggatggcgtctatggtggcctggatggagaggccgcgggggatctccctgtctatccccaatgcgactatgtgaccctccgtggaggagacctcctccgcggggatcactatgaccttgccgttgtccttcacgtcgaaataggccttgaagctgttgtgatcggttatcgccacgcagcctattcccctctcgatgcaggcatctatgacctgctggggggtcgacttcccgtcgttcgaatagttcgtgtggacatgcaggtcggcgatcatctgacgcctgccccgtccttgatgtcgccgtccacggtggccacgcatcccttcccgtcgccgaggacgaggaccctgcccccgtccaccacggccgcgacgcgtgcaggcgccccggcgggcagttcgatgccggcaccctcggagacgaagacaccgtccttcaccgaggacaccttcatggtcaccgcggagaagtgcttcttgtaatctatcacgtcgccggagttctcgagaccgcagttgaacctggtgcccacgggtatctccgggtcggaaggcctcaggagcagcacggcgtccccgccgaggtcctcgtcgtcggccgccaggagcatcccgcacgactccacccctctgagggggcgcggggcgaggttggtgacgactatcgccttcctcccgagcatctgctccttcgtgtagtaggccttgaggccggcgcatatggtcctcggggtctcctcccctacgtccacctgcagcttgaacagtttgtcggcgttcggatggtcctccacggagacgaccttgccgacacggaggtcgagcctcctgaacgcgtcgaacggctcggcgggcctcttctcctccttggcggcctcgaccttcttcttggcctccgcctccggctgcttgaacaggtccgggaaggtcaccttgaggtcgatcttgccgtatacggggacgggttccttcatccgcgtccctgcgggcagaggggtctggacggacttgtatccggcctcctcgacggtgcccggaagacccatgtagtcccagatcttctcggaggacctgggcaggaagggccatgccatgatggcgagggccttgatgatcctcaggttctcgttgagggccctgccgcaggcggccttgtcctccttcaccagcttccacggggtgcaggagttgaagtactcgttcccgaagtgcgccagacccatgaccgcctgcagggccttcttgaagtcgcatgcggagaggaacctctcgtactcggtgtacgtcttgaatatctcggaggacaccttctcgtcggggctgtcgttctccgggatggtgccgaagttcttgtaggtgaagctgagacacctgtggtacaggttcccgagggccgcgacgagctcgctgttgaccttggtctccatgtcggaccaggagaactcggcatcgtgggtgtcgggcatgatgatggacagatagtacctgatctcctcggggtcgaacttctccaggacgcggggcatgtcccgggggatcatggattcggcgtcggtgacggcgcccttcctgctcttggacagcttgccgccgttgaacatgaggtactcgttggccgggatgtcgtaaggcaggttgagtccctgcctcatacccatgagcatggcgggccagatgatgctgtggaacgggatgttgtccttcccgatgaagtagtagtgcttgcagtcgggattctcccagaaggtcttccagtaatcgggctgcccgatgtccctggagtgggcgatggtcgtgctgaggtatccgatgaccgcgtcgaaccatacgtagatcaccttgtccttccattcctcgccctccaccgggatgggtatgccccaggacatgtccctggtgatggcgcggtccttgagaccgcccttgaggaagttctgcgtgtacgccctgacgttctgcctccagtacttcttgtcgtccaggaactccaggaggggcttctcgaaggcggacagcttcaggaagaactgggtggaggacctgacctcgggcctggtgccgcagcgggtgcagtgggggtcgatgacgtcccctgggacgaaggtggtcccgcagttgtcgcactggtcggagcggacgtcctgcatgccgcagttggggcacgtcccctccacatacctgtcggggaggaacttcctgcacttcggacagtagtactcgtcctcgtcctttgtgtagatgtatccgttgtccaggagggtcctgaacatccactgggtgatctcggagtggacgggggagtgggtcttggaatagagggtgtactcgatccccaggtcctctatcgccttcttgttcatggcgtggtacctgtcggcgacctcctccggggtgacgccctccttgtccgcggtgactgtgatgggggtgccgtgctggtcggaacctccgacgacccagacctcgttgcccaggagcctgttgtagcgggcgaagatgtccggtgggagaagagagcccgcgacgtgtcccagatggatgggtccgttcgcatagggccatgcgatgtttacaaggactttcgacatatgttgaggggtaacgacgcattctccttataagagtgtgcacgcgcggaggtcaggatgtgttgcctgtacctccgcggaggcatgaatccccgaacctgccgatgtataccttcgccagccaggccatgagggcccctcccgcgacctctatgaccgccatgatgacccagatggcctcggtgctgcggaagaccgccgccatggcgaagtatccggacaccatcaggatgttgcgtatcagcgacgacaggaacccgatctccgaatgttccagcgattggaggaaggcggaacccacgaacaccatggacatcatggggagaagggccgccaggcagaggaggcagacggtcatgttgtcccggaggtacgatatgtcgtccgacgccgtgaacatgcacgctatcgggtaggacagaagtgccagcagtacggagagatagaatgtgtggagtacggagcggcgggcggtgaaacggtaggcctccgcgacgaggtcggcacggccgcgggcgtattccgtcgaacacaccgacaccacgcctccgctgagggcctgacacgggatgaggaccatgtaacccaccctccatgccgaggtgtaggtaccgaccacgttggggtcccccaccccgactatgatgtagttcatgggtatgttgatcagggacatgaccatgtactcggcggactccggaagaccgacgcacaggatctccttcgccacgggccaatcgggcctcaggtccctgatacggaacctcacgtacatatcgtccgcaccgacataatagtaaagacccagacacaacgagagtgcaccggcggccaccgtggccaaccccgccccggcgacacccatgcccagaccgtacatcagtacggggtccaagaccatgttgaagagtgcccccgccacctgtatgaccatggaacggcgggccgcaccctcgcccctgaggacgcccgacatgacggacccggctatgacgaagaagctcccggcgaagatcggcatcccgtaggcgacggcgtccggaccggcctccccggcaccgaacgcatacatgatgggttccgcgaatacgaccaaggggacggtcacaaggacggatgccgcaagtgccagaagaagggattggccggcggaacgggtggccccctccctgtcggaaagcccaacgcatctggcgatggcagcggcgacgcctatgccgagaccgttgccgatgcccactatggccgcatagaggggatatgccaatccgagacctgctacggcggatccccccagccatgcggcccacatggtgtcggccatgctgttgaagttctggacgaatatcgctacggccaaaggtaccgccagggccggtatggcgaccttcgggtcgctcagcaggaccttggtacccgacgttccctccatgatatccgaatcctccgaacacacctttatggtttcgagacggccggaatggacctaacgggtatgaaggttatgtgtagaatatataaacggtatttatatccaacacaaatagtatattaattttactacgaacgtataaatcaacggaattacatcagtagattactgaaacatctgacaagtttcggcacataaggagcatgaccgggaggtcatgcggactcagcgtccggcgacggacggcatggatgcaaaacttgttcatgaaaaaggaaagaggtaatagaatggacttctacacagcatccgtaatctggatattctctgcagtcggcctggtcgccctcaacatcgtgagcggtctcgacctcatcggaaacatcatcatggacgcatgcgtcgcgatcaccgccatcggattcctcggatacaagagggtctacgagaagatggtcgcccctgtgactgcttgaaatcacttaaccggggacctgttccccggttcctccataaacaccttgtttcttcgattcctatttttacgggatccgacaccgggtctcctcgtaatgtttccatcgcatccttacagtcaacagatctctttcgatatcgggattccgaaagtacggcaccggacctccgccggaggatgtattataagatgaccggacgggcatccgaaggaccccgtccgttgagagggatttgattccgcatccgcacgacggtctcagtccagggttatcctgaagacggagccgtaatcctgatgcatgcacacggtcgcgctgagactcttggaatcgtagacggcgctgtactgggtcatcgacgtcgcctctgtcccgggatcctgtgcggcgacgctcaggatgcgcatggcctgctcccccgtcatcttggcggcacggtcctcccgggagaagtcgatgtaacgctccaatgcgcttactatcccggtgagacggtggtacccgtgaccgaaaccgtacttgtattccttcacggagttctccaggcgcaccacgttctccatgaggacaccgttcttgtagtagtcctcggcatcgtcgaatccggagtagaagttggagacggcatccaccttggtgacgcacagcttgttgtagcgccactccaatacggcggaggcgccggtggagtcggtcacgaatatgtggaagtccatgccgaacacccccttgatgttgtagtccccggccatggcgacggcctcatccaccgtggcacatccgtccaatatgtaacgtgtcagaacggaatgcccgatggagatcttccccgcatccttctggtccacggacgactccccctccttgacgtcgagtttgaggatggatacggtcagccccttctcgttgatcccgtccacacatacgtacggaagcatcacgagcatggaggtgtcggtcctgccgtcgtccaggacccctgcggagaacgtcgcgttatcggaatccagccaatacgcgtcggcgatggccacggacctgtatctcccatcgggggcgcagtgtatggcgacgttcagaccggtatatcctccggcggcatccgtgtgcctgtaatcgtagttcctggcggtcaggacgctgtcccccgtctcgttgaaggtgacgaatgcggagcacccggcgtcatagacgccgaatttctccatgagggaagtgatgtaggggttgccgtagtagtcgtagctgcagtccatctcatagaggaatccctctttgtcgacacggtggacggtatcgagcgatgcggacatctcgtcggtcagccattcgaatgaatggggattgcccggacccctgtcggccccggacggtcccgtacttccggatgatggagctgtttcggtcttcttatccaaaattgtcccccctttaacactgtgggtatgtcacgaaacaagtcgtgcagatataaaaaataagacaaggacccagtcggtcggcggcgtgtaccgccccgccgcgggatgacacggtctccggataccagtcctgtaccggaccttttccgcccgcgcacgcgaattatatttataactgcgatagatgggtcgcatcatgaggatcgcggcggtcttgttcgacagatgccagaacaagaaatgcaacaaggaatgctacaagttctgtccgctcatcaggacgggagtgaatgtcatcgaattcggggagagggggaaacccatcatctccgagacgctgtgccagggatgcggcatatgcgccaacaagtgcatgttcaaagcgatcaagatcatagggctggccgacgaactcaaggacgagatggtcaaccagtacggggagaactccttccgcctctacaggctccccgtccccaagaagggtatgatcaccggtatcctcggacccaacgggataggaaagaccaccgccatcaacatcctgtccgggatagtggtgcccaacctcgggaactatgacaaccctcccaccaaggaagaggtccttgcccactacaaggggaccgacatctacccctacctcagcgacgtgtatgcggggaagataaaggtggccatgaagccccagtatgtggacaagctccccaaggtcaccaagggtgtcgtcagggacctcctgagcaagacccaggagaggatgagtctggaggaggccgtggagacgttcggtctggaacaggtcatcgacagggacctcaccaaactctccggaggagagctccagagggtcgccatggcggccacgtgcatgaaggatgcggacatctacttcttcgacgagcccacatcctacctcgacatctaccagagggtcaagatggcccgcataatcaagagcctggccggcgaggacaagtatgtcgtggtcatagaacacgacctcgccatcctggactatctggcggacaacgtcaacctggtctacgggtcggagggcgcatacggagtgttcacgctcggaagacaggtgaggaccgccatcaacgtctacctgcagggttacctgcccgaggagaacatcaggttcagggagagacccatcgagttcgccgtctccgcaccgtccggggagtgggacacacccaccctcatcgacttcgaagacgtctccaaggatttcggcgaattcaagctggatgtcaacagcggagcggtgaagatcggggaatcggtaggggtcgtcggccctaacgccaccggtaagaccaccttcgtcaagatgctggcgggggagatcaaacccgacaaaggatgcgtcaacgggatcatgaggatctcctacaagccccagtacatatcccaggactacgacggcaccgtccaggactacctgtgcgccataaactacgaccaggtcaccagcgggttcttcgacacccaggtgatcggtcccctggccatcaagttcctgatggacaagcagatgaagaacctgtccggaggagaactccagagggtcgccatcgcagggtgcctcgcgaaggatgccgacatctatcttctggacgaaccgtccgcatacctcgattccaatcagaggatggaggcggccaagtgcataagcgggatgatggagaagaccgggcgcagcgcactcatcgtggaccacgacatctacttcatcgacatggtctccgattcgctcatggtattcggcggggaaccgggacaccacggtatcgcggagggaccgtacaggatgcgcgagggcatgaacaagttcctgaaatccgtcgacataacgttcagacgcgatgcggacacccacagacccaggataaataaagaaggatccaacctggacaggacccagaagtccgtaggcgaatactactacgccgagcagtcctgacccatcctcccgttaggcatctggaacatactgtcgcaccatatctactgaagttaagtgtaatttgaaataggtcgataaactaccatggtgcatggaaaggatgggaaaggctgacacccatgtccatacggactattccggattcaacagtctgggactgatgagttttccggagtccgtcatcgatccggcgaaacaggtggacgatgccaggagaagagggctcgacgtcctctgcatcaccgaccacaacgaggtcgcaggagggatcctggcacagaaatacgccaagaagttcgatgacatcgacgtggtggtcggcgacgaggtcatgaccgaccaaggagaggtcataggcctctggctgacagagaaactgaagaaatggctgtctccggaagaggccgtggacatcatacacgaacagggaggtctggccatcgcaccccacccgttcagtgtccatgtggacggtatgcaggagaagatattcgatctccccatagaggggttcgaagtcatcaacggcggacaccccgacccgtactccaactatctggcacaatgcatcatggacaggcatcccgggaaatgggccgccacatccggatcggatgcacattcgcttttcacggccggatacaattggacggaattcgaaggaaggaccgaggacgacctgaggaaggccatcctccgcaagaagaccgtccccgtggggacccccgcaccggtgctgggacaggtccaatggagcatggaggtcgtgtggggagggcagaagctgatgtacaaggccctcaggggaaaactccccgaggtcgagaacaactccctgatccacaagatcaactccatatccgatatcaagaaggccaccggcatcgtggccggattcgcgtacgagttcccgctcacgaacatgctggccaccctcctgagcgtatccttcctgaaaagaagggcgaagaaggccatgaggaacatcgacgagcgtatagcgaacatagaccgcatcatagccgagaaggaggccgcggccggtgacgggtccgagtgaggtctacggcatcggggtggatgtgccggcatcccacctggagatgctgatggacgccatagacggtgtcatggaacccgtctaccccggataccgccgctccttccgctacttcccggtcaaagggacctggaagacggaggaggggtcccatccgttcatagggaaggtcggggagatatccgtggaggacgaggtccgtctggaattcgtggtcggaaaagaagacctggaaagagttttggaaacgatagacaggatacacccttacgaggaaccggccgtagacgtggtccctcagatagggtggaggtccctcattcgtccttctccttgatggagaatatcgagtcgaacgtcttctgaagcctgaaggtctttatcccctgcttcctgtactccacctcttcgtgactgatcaggccgtccttctcgaactgttccaggagtctgtccccttcgtcgtagtcgtaatggacccctacggccacgttgagcttgtagttcctgcagtagagggattcgggcagaaccccgccgttatccttcaagacgcgctccatgacccctttctccttgagaagggcgagacccctgtcgcacgccttgtcgcagcggtcgtattcctccatgttgtacagggccgggatcgacacctcgttgacgtagaacctctggatgccatccatccttatgtcttccgtgctctcggcgaggaaggccacgaacttgtagttgtgatcgtcgttggcgagtttggatacggagcatatgaaagcggatgcgctggagggatcggccccgtccatgtaacggttcagcttcaccttgtctgtatcggaaagcgtcccgtaccatttggacagctttgcttcgcggatcttctccggaacgtccctgttaccgattccgaacatgttccagcgtatacgttccgagtagaaaatagtggcccccggaacaggtcattcgccgctcttcccttcatccttggtatccgatatgcgctcgttccttccgcgcacggccttgagataatgggtgtcgttcttgatgaccgtgtcgatacccagatattttatgtccacgaaaccgacggcacggtggtcgcaaccctcgtcctgacagtatctgcagaacatgttgtcgcaggactccgccatgaacgttatgtccacatcgtcgcccagctggtccttgatggctttggagaagcggtcgactatcttctcgacctcttccacggtcagacgtccggggacggtcatgtgggcatccacgtggacggacgacccgtatctgacgaccctcagatgatggacgtcgatgacgttctcgtccctctcgtggttgatgcagcgggtgacgaccctcaggacctctatgtccgcactgtccatgatgccgttcatggatttcagcaggacgcggacacccgtcaccacgatgacggcaccgaagatcaaagccatgatgggatcgaaaatacccagatcgtatcccaatgcattcccggcatacactatgcctagaccgagaaggatcccgacggaagaatatgtgtcgctgcagagatgcttgccactggcctcgagggctaccgaattggtggacctgcccatccttatggccgtgtaccccatgacgaagttgaccagtgcggcgacggcgacgatgaccaatccgatgtccagcgagtttatgtcggacggatggaggaacctgtccacggattccaggattatcagggcaccggcgatggagatcatgctcccctctatggacgatgagatgagctcgatcttcccgtgtccgtagggatgggaatcgtcggcgggcttcatggtgaggtacaatgcgtagaggccgatgacccccgcgaccacgttgactatactctccatggcgtccgtcaggatggccaccgaaccggtgatgtagtatgccaggaacttcccggacatcaggatgaatccgactgccgcgatgaccttctggaaattgtagttgcgcctcgcggcctccatcttagccttgtccatcgtccgttcatgtaaaaaacgaatatttaggagttttcgagtttaaaggaccctcaaatcgatttaaggcattcctcatccgtactccctctgaaccaggaacacaggatccccaccacgcacatgccgagacagatggagaatgcgaggcgaatggtgtcgacgaagtcgccgtaggtggaaggtcccagattgtccgtggaccccattatgaccgctatggaggccatggctatgctcatcgagaccatcatcccggtctgacgtacgacggatacgacgcccgacgcctccccccggtacttgcccgggacggacgacattatgacggaggtgttgggagacgagaatatccccatgccgacgcctatgatgagcatcatcagcaccacatagggcagcgagaactcggtccccaggaagaggaacatggcgacaccgaaactgacgatcagcataccgagggtgggcagtatgcgcttgtcccccatcctgtccgagagggcacccatcctggcggtgaggaggacctgcacggcgggctgcacgagcatgagggcccccgcctgcgaggcggtcagggccccgatgctctggagatacagggacatgaagaacgccacggagtaggaggcgccgtagttcatgaacgccgccacactcgacctgctgaacatccttatcccgaagagacggaggttgaggacgggactgccgcacctccgcagataccatacggtcaccaggaacagtcccagtcctgcgaccaccatgcctgcggcgagacccgaggtgatgtttatgacgccgaacatcagaacgaacacggatacggaccagaggaccgatcccttccaatccatggcctcctccggcgtgggcgtgacctcctttctgaagttggatacgaagaacagggagacgatgacgagtgccagcactatgacaaaacacgccctccacccgacggcgtccgacaccaggcccccgatcgtgggtccaagggagagacctatgtacaccgaggtcgtgttgatgcctatggcccatccgcgccgctcccgagggaacacgtaggtgagcatggcgatggacgtcaccccgatcatggccgacccgaaccctatggcgaaacgcatggccacgaagaatgcgaaaccgggactcagcatcgcaaggaacgaggtgacgcccgttatgacgagacccagaaggaacaccttcctcatcccgtagatgctggccagccttgcggaggggaccatggctatcacggagccgaggaggaacatcgtgttgacgtatccgaggtcgtgggatccgacggagaactcgtcgcctatgaacatgagcgcgaggttcatcatcgtgctcatcagaggggttatgaacgcaccggagaccgtacatgccaaaaggtgcttcctgtccgaatccgtatacgccgagtcccccatgatacacactaaacggatactctcttaaagttaacgattaactatagatgaccgcactaagtgaataatcctctaccatgttctgaatcacataggaatattttcgtcccgtccagaatagaatcccttcaatattcatatatgaattaaaatgatagtttgggtatgaattaagatttatattgcattgtcaatcgttatagatatggcaatatacagatcgctcaccgaggctataggcaacacgcctctcgtaaggctcaacaggatcgctcccgcaggaagcgaggtatacgtgaagatcgaggggaagaaccccggaggatccataaaggaccgcgccgtcctctccatgatcaacgatgcggaggccaggggactcctgagacaaggagggaccatcatcgaacccacctccggaaacaccggcatcgccatcgccatgatatcggccgcccgcggatacaggtgcgtcctcgtcatgcccgacaccatgtccaaggagaggcaggcgtacatgaaggcctacggtgcggagctcgtcctcacccccggaaaactcgggatgaaggggaccctcgacaagaccgaggagctcctgaaggccaccccgggatccatcagcctcggacagttcgacaaccccgcgaacatcctcgcccacagatccacgaccggaagggagatccttgcggacctgcccgacgtggactatgtggtggccggattcgggaccggagggaccatctccgggatcggttgggcactgaaagacgccgggtcggacgccaagacgatagctgtggagcctgccgagagcgcactcgtgacgtccggacaggcaggaccccacaagatccagggcatcggagcgaacttcgtacccaagaacctcgacaggagcgtcatctccgagatcaggaccgtgaagggtcaggatgccatcgacacgaccaagcgcctcgccagggaggagggcatattcgcagggatctccgcaggcgccaacgtcttcatggcattggaggtcgccaaagagaatcccggcaagaagatcgtcgccatcctgccggacggcggcgacaagtatgtgagcatggggatcttcgactgagaccccgccatgcgggacatcctcaggagtgacatcgtatgccgataaaagtaccgaacgaccttccggccgcgacagttctcgagaacgagaacatgttcgtcatgcgcgagaaccgcgcggcctcgcaggacatacgtccgttggacctgctgatactgaacctcatgcccaccaaggtggagacggagatccagataatgaggctcctgtccaacagccccctccaggtcaacgtacgtctcctgcagatgtcctcccatgtgtcgaagaacacgtcccaggagtacctggacaggttctacgaccgcttcgacgacgtgaagagcaggaaatgggacggcatgatcataacaggggccccggtggagaacatagacttcgaggaggtcgactattgggacgaactgtgccagatcatggaatggtcgaagaagaacgtcttctccaccctgcacatatgctggggggcgcaggcgggactcaactaccactacggcatccccaaatatcccctcgagtccaagatgtcgggggtcttcgcccacaaggcgatcgtcagggacgaccccctcctgagagggtgcgacgacatcttctggttcccccactcgagacataccgaggtcagggcagaggacatcataaggaacccccatctccacatcatcgccgtctcggacgaggccggggtggggatagtcgtaagcgagaattccggacaggtgttcgttacaggacacatggagtacgacgccaagaccctgtcgtacgaatactacagggacctgggaaagggcatgaacccccacataccgtaccattacttcccggacgacgacccctcgaaggacccggtcatgaactggaggagcacggccaacctgatcttcaccaactggctcaattactatgtgtaccagagggtgccgtacgacatcaacgagatcggaaaggacagtgagtgatatgacggatactgtgaacacggacaaggccccgatggccgtagggccgtattcccaggcgatcgtagccgggaacatggtcttcacggcgggggagatacccgtagaccccaggacgggggagataccggagaccatcgagaagcagaccgaactggcactctgcaacgtatgggccgtcctgaaagccgccggcgtgaaggaggacggggccgtctcggtgacggtctaccttaccgacatcgaggacttcggcaaggtcaacctcgtctatgccgagcacttcagacagcctttcccggccaggtcctgcgtccaggtggcggccctgccgaaaggcgtgaagataatggtcagcgccataggcgtcagggagtgaaccggcccggaaacaccttacacccataccggaggcagtcataccccgtttatcatggggttgacgagcttaccgagtatggcgtccctcaccatcggattgagtctggagaggtccttcttctccgatatgaccgcatcgacctctttcttcacgtgacggaacacgtcgcggtatatgcggcaggagtccccgtcgcggttccctataccgcactgataatacgcatcgatgctgcagccgccctgacagtagtcgtagatatcgcaggactggcacttggccctcctctctatggagcccttgagcatcctcgcgaacccgtccgtacggaatgcgtccgacatgtgcgatatcccgtcgatgctgcacatgcggaactcctccggacaggccttggcacagggatacaggtcgccgttgggatagatgcagacccatttggtaagacatgaggtgtgggcgcagtcggacggctgcgggtctccgagggccgtgaggacgtacagataatggggagcgagaggtatcctagcgtccgggtcgttgaaccacttgtcgaagacctctatgctgccgcgtatatactcgtccggatcggggacgagtccggggttcttcgcggcgcatcctgccgggatgaccgggaccatgctgatggacgcccctatcccgttgaaatgatcgtagatctcggcctgtctcgactggctctccttggagatggtggcgctgacggcgaatgccctctccttgtcgctcagaccgacgatgaggtcctctatcctgcggccgtcatgcctcaggatgtcggcacacggaccttcgtgggagataccgatgtttatcatcttctccttacagaacttcaccatcctgttatccaaggcgagaccgttggtctggatggtgtttcccaccttacccgtgccgaaatacttctcctggagttctatggctttcttgaagaaagagaacgggagcgtaaggggctccccgccgtgccatatgaaccatgctccgtcgtactcctcggatacaagacggaataacttctccaacctttcaaaagagatcctacctcccgaggatctctcctcgggggtgtgatagcaatgcctgcaccccatgttgcaggcaagggtgggttttattatgaccgaaaggaagcggctcatggtgtagccggttcttcagatcagaagggccaccaggtccaaataccgttgaacccgtctgttacatagcagcagcacatgcagcatactacgatcagacctatgcaggcggcgtgctgtgcaggggtcgcacagtatcccctctcgctgcaacaggggtactcgcacttggcgtccccgtggttctgctcggcgttcttaggtgcattgtagtcttttttctcctcttcgccggtctggatggccatgacggtaaaggcgaggggcgactggctagtgtaggaagcgattagatcttcgacagactgtgacattaactcaccctgccaattgctggctagatagtctgcgtaatggttccgtctattaaaatggttttgtccccctttataaataaaaatatatgcgacgggagtacaggaataaatatcgataaaatattcaaatcttacacgtcgatgatttaagtagcatgtgcgatagacgtcccgatatgttcggttacaccgtcccgttatactcgcgcatgccgtccccggaacgtgctgcgtaccagaaatactactgcgagacctgccatcagctgaaggccggtttcggtctggtcagtacggcgacggtcaactacgacatgacattcaataccatcgtcctcaacgccgtggccggggatgtacaggagttcgaaggaacccccaaatccgtccggtgcgtattccgcggaccgaaggcggactcggacatcttccggaagatggccgcatacaccgtcctcctcacgaaatgggagctggtggacgacaggaccgacaaaccgtccgtcaagaccgacctgatagacctgacgctcggaagggcgatatccaaggcggagtcgatgtatccggaatacgacgggatcgtaggcagggggttcgggcgtctccgcgacatggaactggacgggtgcagcgacgccgtaaggatggggaaggagttcggaaaggccctgacggagcccctcagcgacatagccggcgattcggacttcccggaactcaggtccctgttcaccgacctcaccgccgccgtctacgtgatggacgccatagacgacctggaggacgacttcatggacgggacctacaacccgttcctgcaggagtgcacggacttcagaaaccgcgacgagtacgtgaggaagaacctctacgggctgacgggtctggtgaacggggtgatcggtgacctgcagagggattattccgcggtgagaagacacatgaggtccatgacgggcgtcacggacaacatcgtgtatctcggcgtaccggaatcggccaagaacgccgtggcgggaaggagcgcggccaagatgagcgtgaagaacgccctggacctgaggaagaaaaggacatccacttactgatcgttcagggagagccttccgcaggggtcgtacttatcgcagacgttcaggatgtcggtgggctgcttcgtgatgccgcatacggcgttcccgaactctatggtggcatgggaacagttctcgcagcatcccggacggtatctgggacatgattgtttggcactcactaccttgttgtttatcatgcaggcccagtcttcgtccgagtggacacagtacctgcatacgtcgcatttaccgtacctttcgtctgtcatgtgcggattccagtctatcaggaggttgtagataaagatgctggacacgtcctccgggacgtcatgaatccctttataacggggcgtccggatgcgggtcttacgatgttcgggaacataaggacggacgagagacacacggtgagggcatgttacaccgcctacgtgatccaggcgatcatcgtcacgttcgccccgctcctgttcatcacgttctcggacgaattctcgctttctctggagaggataaccctcctcaccaccgtgaacttctccgtacagctcctgttcgacctcgtatgcgacccgatcgtcaggagactggggtacaggaccaccatggtgctgtcccatgcggtgatggcggcagggctcgtctgcatggcgttcctggcggacatcatgccggatccgtacgtcggcctgctggtctccgtggtcgtatacgcatccgggggaggattgtcccagatcctcgtaaaccccataatcgtgtcgtgctctaaggacagcagaggaggggccctgtccatggtccattccatgttctgctggggtcaggtggtcgtcgtcctcgcctccaccctgttcttcgcggcgttcggtacgaaggactggagactcctggcacttctgtgggcggcggtcccggcggccaacatgctctacttcatgctcgtaccgatagacgagccgggggcgcatccggaaaggaagaggatgtcctacaggtccctgacgtcgcagccgctcttctggctgttcatcgtcctgatggtctgctccggagcctgcgaacatgcgatgagccagtgggcgtcggcattcgcggaatccgccctcggggtgagcaagaccgtgggggacctgtcgggactgtgcgcgttcgcagtatgcatgggtgcggcgaggacgctttacggaaaatggaatggaaggatagacctctggaggatgatgatcggaagcgccgtcctgtgcaccgcatgcttcgccatggcggccttctccccctggcctgcgttcgccctcctcggatgcgccgtatgcggattctccgtggggatattctggcccgggacgttccacatagcaggtacggccataccggcgggcgggacggccatgtacgccctcctgtccctggcaggggacataggatgcgccggaggaccaacggtggtcggattcgtggccgaggccttcggagacgacctgaagatagggctcgcgatagccgtggtgttcccgctgctgatgatggccggtctcatggccgccaagaggaaggtcggcatgggggatgggaccgacgggtcatgatccggaacccgctcgggacctctcgagaacatcgatgcagaatcctttcatgacctcgagggcggcacgaccgagagagtcgtcataactggccaccaacctggggtcgacaaggatgtcggcctccggaagagccgtacgtatgagggccgcgttgactatcacgcatatgttggtggcgaccccgcacagctcgacctccccgtaccctccgtcggaaaggacatgtgccagcttctccgacccgaatgtcggcttatcgatgacggtgcacgtttcggaaagatccctgaggctcccgtggatctcccagccgtaggtacccctgatgcaatgcgtcacagggatgtgggagccctcgttggtgtccggatatccggagtcatgggtatcacgggtgaagaacacgtcatatccatcggatattgcttccttcacacgggcacaaagcgccccctctatggagcgggcggcctccgaacccaatgtgccagatacgaaatcgttctgatagtcgatgacgaccagcgcacgtttcatgccacagggatggacgtatccgttattaatccctcagacgaggatgtggtcccctgcatagtggctcttcacgatggcgtagacgtcgctgaaacttataccggtcgctatggcgatggcggtacaggactcaccctccgcatatctccttacgacctccttcatcaggtcgggaccgatcatgctgcgggagaccgacctcaccctgggggaagactccccggtcttgacagggaccgcccatttggtggaatggcatttgggacacctcttgggctcctcgttgacggttccccacttatggttgcatctatagcatttacagatgtggtaatccttcatccataccgtggatctgcacttgggacagtttttcggaagaccgcctttcttgcgtgcgacccagcgatgggaacacctggaacagacgtatacctttcctgcggtcaccggaccttcgtaaggcatcccgttaacggagtcgccgctacccatagaaatcacttccatatccctctggctccgatttaataaagtttgcgaacatgttcgataaagaacaatagccagacatacatttgcagatgccatgacaagacggccggcggaccattagggcccgatcccgtaccgaccgataacaaaacacatccgatagatgcggggacggtttcccgtcccccttggaggaagaagtttatgatgatgttagtggttagacgcggacagtccatgaccgtcctcgaaggcgctgacgtatatgtcggacatctgtcacatccgtagacgtattgacgccaatgcgttagattgggtgaggctgtatttaaaggttcgttgaaaattggctttgtatctaaattttgttttgcacttaaattgaaaatctgcacctaaagtctttctgagactttagaagctgcaaaattagaaacttctttgttacttggctctattatgtcattcgtagtgtcatcgggtatgcttttagcttgagttggacaattgagttttcgatttttcaggattccttggcgatcgggtggacttgagcggtgcgcgaaaatcattaccgatttagaaccgtcgtcattggacagttgccctgattttcggcttcctcttggggacattcacaggcttgggagggtattatgggcgattccccatcaatccggtggtgccctcgctctgttccggcccttcatcctcctcgtcatcgtcgatattgatcaccctcatgccctcgatccagtaccgggaggagggtatatgcgatggaaaaatggtatccgagatttactatccactaaaattattcaggtttatgtttgaaacctcttttttatttttcaattcttcaagttccttatcaatccattttggatgaacattaagaatttcaaaacaatatgtgtatattccgtctgaaatttctctttcatcgaacgatgtattctcataaatcatttgcacaatctcgggcaaatcatcttcagaaatctcattaattggtaatttattattgctacaatattgtttcaagtaatctattgagtagaacattacatattttgttctacattcattatacttaagtttgtagaataagttggctaggattatgatagtggatatagcaaaaatcatgggtgcaataatccacatcttatacatcgacactacttctctgaaagtagcgttaaacattaacggaatgtatgcaataataattccattcaaaataattatccagaagtgaaattgactggctcttatggcttctgcttttttaaaattcaactcagcactatcattagtactaatcaaaaatgaacccttcaaagattgtatctcttctggcgagcgatgaccttcttagccaacttcttcttgaaccagttgttgttacaacaatacatcctctcgccataacggtcttgaatgaatctaaaaacgattagcataaccaacatcaacagtattgccattacagaaactgctataacgtcaacacccttgtcgagtaaaatactagcaagacagataggcggcacgctcacacccattagagccatcagtgtggtaaacactgatttggaaacactggttcttgtgcaatcagtccacggcatatctgctcatccccaacttaacatcatgtatttaatacataagcttaagccatatattttgaacctaagttgttttgcctgcacctaaagattggtagagaccttactttaggtgcaaagccttgaaaaatgataaattttgatatatcaaagtgtggagacatcgaaagacggatgtcggacggcgtatcacaacccgtcctcgacatcccggagatacgtcttacggatgccgtcgcacaaggacctgtcatggaaccctacaccatcgatagatgccactggcattatgcccaggacggagttggtgacgaaacatccgtcgaaaccgcgtagatcctccgggaagaacaccccctcctccgcaccgaacttctccatcacgtaggatctgaccgtccccggaagaagtccgcatcccttttcgggggtgtacagcctcccgcccttggagaagaatatgttcgtcgtcgccccttcgcatatctcccctctgcagttcaggaacaggggctcgtcgaaaccgtccgccttcgccttgcgtttctccattatactgtcgccgtattggaggctcttcatgtaggtgaaaggggaggactcgttcctcctgacatccgggatacggagcctgaaccccctggcataatcgccatcggaatatgggacgggtctgtccgagagcacgacgttcctttccgagacctccaccttcaagaccctgccgtccaggtgcccgtcggagacctcgtcttccagcatgcgggggtccacgcggtttcccacccccagagactccaaggctccgcggagccggtccatatgtctgacgaacatgatgcatctgccgtcatgtaccagcatggtctcgaacgcccctatgccgaaagagaaaccgtcatcgtgctccatcatcacccctccagagacctcagcatggccaacgccttcagcgacgtctcgtcgtactccgcgtcgggatcggattcgtatgttatcccgctgccgacgcctatggtgtacgtgtcccccgaatgcaccatggtacgtatggttatgctcatctcggccatatgcgcggagaagatccccatcgaccccgtatagatcccgcgcctgcatgcctccagggaatcgatggtctccatgcatacctccttgggggcaccggtgacagatccgcccgggaacatgcatgagaccatctcccccgtacgcaccccttcccttacacggccgacgacgtcggagaccgtgtggtacagggtggagtagacctccggacggaagaacgatcccacatccacactccccgggacgcagaaacggttcatgtcgttgcgttccatatccgtcaccatcagcagctcgctgcggtccttgtccgaggaaaggagtgcggacaggctgtccctgtccttcttagaatcgccggtacggggggacgtaccttttatggggcgggtgcggacgacaccgtccctgtggtccagaagcatctccatcgacgaagaggcgatctggatcccgcagaggtccgcatatgcgccgaagggggatgggctcaggcgtctgagtctgaggaacgtcccgaatggatcggaggaggagcggacggagatgctgcgcgacaggttgatgacgtagaactccccctcggccatcatggaacgcgcctcctccaccgaacggacgaaatcggaacgggacatgtcggagacgacatcgtatccgtgaccggggatgtcctccggaggagacgcaccctctacgagacgcatgacgaacctctcctcgtcgcatacgggcatgacgcgcccacggcatgttacatgaagccgcttcccgacaggatcctcctctatgaccacgtcgaagtccgccaggatgaaatcggggatctgggccttcggatgtatagaagatatcccatggagggagagaccgtagtcgtacgacagatatcccatcaggacgtcgtcatcggacatcccgtcgaggacttcgacggcatcggactccccgggaaggaacaccctgtggggcatgaggcctatatacgacctcccgccgcccatggaagagtcgagaaagacggtatccctgcggtccatcgaggaatagatccacagtgccggtacatacttcagacattccaacgctccacctccctgacgaaattccccacgatgtcctgcccatgctcggtcaggaacgactcgggatggaactgaagcccgtatacggatatctcacggtcggagacggccattatgtcgccgtatccgtcgaccgcatccacctccaggggatgttccagcgtatccgggtccgcacacagggagttgtatctgacggcatggaacggatcagggaccccctccaatatgcctttgccgtcatgacggatatctgtgaccttcccgtgtctgggtcctcccctgcggaccaccgatgcaccgtacgaggcgcagatcgtctgatgacccagacacacgcccaggacgggtacctccccgcggaatctctcgaaggtcttccaagaacccctgtcgggggagggcctgcccggtcccggggacaggacgagggcctctacatcacgacgggacggcaccccgtccgcctccttcacgacggtgacgtccgcccctgccgactcgaggcatgcgacaagattgtagacgaacgaatccctgcaatctacgactaggaacacgatggaacatcctcggttggatagataatccctgcggggaggaagacggacggaaaacgaaggaaagaggtttcccgggaggcagggtcccggtaatctgtttgtgatgcgacctatgacgatcagggacgtcgtcggcattgtgtggaggagtcgttgttcttggcctcgtaacgctgcagtacgaaccacagcgggatgtagatcaacaggatgatcgcccctatcacgacggacgagggtccgtacgcctctatgctgaagtatgccaggcaggggatcagcacgaagaactgatagatcgcgagggcgatggccacgtagtaccatccgcgcggtgcgctccataccctgggctggtccttgaacctggggtccctgtgggtcttgatgaagcagaccatggccatacccagagcgaagcagaatccgaacgaggatgccgcgaggatcattccgggggttcccagcgggatgaggcacattccgaccgcgaactggaacagcatggcgtagatgggcgcaccgttcttgttggtcttgctcaggagcctcggcatgttcccgttctggctcatcgcgaacaaggtcctggaggaaccgaggaacgcggtctggatcagcatgaccattcccgccaccagcaggatgagggcgacgagggctccgatggaaccgaagttgctgacgcagagaggcgcgagggtcgcatatccagtcgtctcgacacccgtgtgtccgagtgttccgtatacggagaacgagacgatgaagtacatgaacaggcagatcagaccgcaggagatgagggccttgggcaggtcccttccggggttcttgtattccgcaccgtatgtggcggcggactcccatgcgcatgcgctccactgggcgaccgcgaggcatccgaacaccatgcagatgtcgtttccgctccatgtccatccagcgggggtgaatccgtcggttatgttgtccagactgaaggtcccgttgaagaacgggatggcgaccacgatgaccagcgggatgatggttataccggcgaggaccatctgggccctggcgcctccgttgagacctctggacccgatgaagatgatggttccgaagatcacgagacccagtatgagattgagcagggtcgaattgacgtcgcttaagaatcctaagtattcgctgaaattactgtcttggaggtaggccccggtcatgatagtgaaaatgggtatgacaggcgtccatgtgaaccaataggaccacgccgtgaacgcacctatgaacttgccccaattgaccttcttgcccttgtacttctcctcgtcggtgaagacgtattgtgcacacgcaccgataccggacactccgaagttggccgccatctctccgatcgccatgttctgaaggaatccctggagaacggatacgacccagatgacgatactcagagcccacagggtcccatccagatcataaagcgaaggcaggatgaggatgggcacacccatcgcgattatgaccccttgcttccagtcgatggatctctccagaccggtatcggcaggggcggcggaaaccgcagagcttccgctggctgaaacactatctgacatacgcactcctccttgtccattcatggaacagagggtcccgaaacagggtggaaagagaccccccggacagtcggaatggagacaactgtcgaatattatatcaaaatagttagtatttaaaaaagactacgaactatcggtttagtataaatactaaaaaatcaaacatatattgttttatgtgttttctcatccatttatatttaaacttaactatttttttaaaaggcagtggaataccagacggaaacacggcgtatgtcggacatcccgtcaccggccttcctcggaaggcatgatcatatcgtccccttccttcctctccttggaaagaaggaccaggacgaacgccgcggccgcggccgcgaacatcacggcccacagagtactgtagttctccagggtgtacacgttatgcaggatcatccccgccacagtggtggccacgctcgccccgaggaacaggaagacgttcatcgacgagatggccgtaccggagatggatatggggaaccactccttcacctgggagaacgagagcgtcatgaagcctccgaagaacccgaagaggccgcatacggcgaaccacacgtattgattgtctatatcgccggcgaggagccatatgaaggcccacaccagcatgaaaacgaatgtcccgaaggccatgaccttcttcttggagcggacgaggcctctgctcgccagacgcccgatgagtatcgtgctggcgatcttccccactccgatcatcgtgacgaaccaggcggcgagggcgaatccgtacacatgactcttgaagtacatgatggacgtcgtcccctggaacaccattatggtgccgtatacgaggaaatatgccaaggccatggtccagaacacccttccgctgccgaataccgtcttgagaccggaaaggacgggcactttgccgtcgctgcggtccgtatcctcgacacccgtctcctccgcacggatctcctcgatccccggcataccgatgttcttgggatggtcacggacgaaggcgaagcagagaagggcgaggaccatggttatgatgccgaggaggaggaacacgtccctccaccctatggcctccgcgaggtagacgaggggggcggaggcagcgagggcgccgacgttcccgacggctatgacgatgccgttgagctgggggaagtccttcttgtcgaaccatactgagattatcttcataagggggatgtatacgacggccataccggccgcgatgaggaccttacccacggcaagggcgaggaaactctccccgaacatcgttatgaacgaacccgccgtcgctatcgccaggaatatggacgatgccttccggggaccgagacggtcggacaggatcccgctggggatctgcatgagggcataggtccagaaatagatggagctcagatattccttcgacccgctgccgacgtcggcgaccatgtcggttcccaacgcgttcacggacatcctgtggaaatagacgaagaagtaggtgaccgcgaggatcgcgaacatcgcccatctatacttgtagaccaaccgcttacagtctgcagcatccatctgaagataaccccgtttctttctatgtaagaaatattaacctagcgaaaaaaactgctaagcgagaaggtgaagtgcatggcgggcaagaggggattcgaacccccaacctacagcttaggaggctgttgccatatccaggttaggccacttgcccatgaatggaagtcgtttttcgagtccagacgaaaccggacaaagcaggagatttactcctgctttatatccttttggtttcactccttcttgtcggcgggcttggtctcgtctttcttggcggcggaccagatctcgacgaactcgacggtgtcgacaccgaaggcctcgcggaggtcggagacgactctgaaccttgcgacgggccactcctggtggaacttggtgatctcggggagggtcacgacgaccttgtctccggggaactcgaacttgaagtcgtcggcgttgccgaagtcggcctcgacgatggcggtcgccttcttgtcgttctcggtgatctcctcggtgaccttcatgacgtacttgaggtcgtggccggccagggggttgttgaagtccaccttgacacgtccggcaccgacggacatgacggttccggtcctgttgccgagggagacggtgagtccggggtaggggttgatctcctgtctgtagaagtccttgacggagtgggtctcgatgagcttggggttcctgactccggcaccctcctcgcaggggacctcgacggtgaactcctctccgacctttgcgtcggcgatcgccttgtcgagggcggggaagagcttcttggatcctacgatgtaggacatgggctcgtacttgaccttctcgttgtagatgccggcgtccttcgctgcggcctcgtcggtggtgtcgtacagtttgtccatgtctgccaggtatgccttgtagtcaaggcggatgactttcttagcgtcgtttgccattgttgaatcaccgtgaaatattcggttgaatgtcttgcgcgattacctcatttatattaaaggttaccctgcctaaaaaccggtccgctggcatcaggtatcactataatacatacgggacaggaggatgtcatgcaggaggatccacgacggatgcctgcgtccgtacggtcacggcatgacattcatctaatgtaatgggacagggatgcgcacacgcatattccgggactccggacgccggtccggagttcggaagatatgcattagacaaatgtctaatcaaagaagaattatactctgaattcaccgaaaataacaattgattgccaaaaatcgaagaacaaacatctagatttttccgattagatgttcaaacattaaatactacctgcaatatacaaacgttaacaaatctttgaggcatttgtgatggcaatcaacaacaagtacctgaaaaccgtctacgacggtctgaaacagcgcaacgcagaccagcccgagttcctcgaggcggtcgaggaagtcctcgtctccctggagcccgtcatcgaggcccgccccgagatcgagaagaacgctatcatcgagaggctcgttgaacccgagaggatcgtcatgttccgcgtgtcctgggtggacgacaacggaaaggtccaggtcaaccgcggataccgcgtccagttcaactctgcgatcggaccctacaagggaggactcaggctgcacccctccgtcaacctgtccatcctgaaattcctcggtttcgagcagatcttcaagaacagcctcaccaccctccccatcggaggaggaaaaggaggatccgacttcgaccccaagggcaagtccgacaacgagatcatgcgcttctgccagtccttcatgaccgagctcttcagacatatcggtcccgacaccgacgtccccgcaggagacatcggtaccggcggaagggagatcggatacatgttcggtcagtacaagaggctcaggaacgagttcaccggcgtcctgaccggaaaggccatcggctccggcggatccctcgccaggaccgaggccaccggatacggtctctgctacttcgtcgacgagatgctgaaggccaacggcaagtccttcaagggacagaaggtcgtcatctccggttccggaaacgtcgccatctacgcctgccagaaggccacccagctcggagccaaggtcatcgcggtctccgactccaacggatacatcgaggacgacaacggtatcgactacaggaacctccagctcatcaaggagcagaagagggacaggataaagacctacctcgactacgacttcggaaagaacgccaagtacaccgagggctgcaacggcatctggaccataccctgcgacatcgcactcccctgcgcgacccagaacgagataaacgaggagtccgccaagatcctgatcaagaacggatgctacgcggtcggagagggagccaacatgccctccacccccgaggccatcgcccagtacaaggcggcgggagtcctcttcgcacccgccaaggccgccaacgccggaggtgtcgccacctccgccctcgagatgtgccagaactccgcaaggctctcctggtccttcgaggaggtcgactccaagctgaaggagatcatgcagaccatctacaagaacgcggccgaggcggccgagaagtacggccacaagggcgacctccaggtcggtgccaacatcgccggtttcgaaaaggtctgcaacgccatgctctggcagggcgtgtcctactgaaaacacccgggaggggcggaagccccctccccttaaaccgattatctcttctcccaacacggccgccatgtgccaggaacaaggtctgcggaccggaatatcataccgtcctcaggcccctggcatgccaaaaaattaaaagcaatggcactatagagagtgctaggccactttggcgcagtccggtagcgctcccgccttgtaagcggatggtcgggggttcgattccctcaagtggctccatatctattatcgagatccggaacccgcttgctgcaatgacccacagatgtgccacatccgaaatacggaccgccctgcatcgaccgtgacaataccctgataaggacgtacggatccgatgacggatatattcaatccaccaggaatatctccgcggtgatcgaaaccaaggccgaatcgtatccgttgagcttgatggtcacgtcatttccggacaatacgctgttcttcgccacatcctgactgctggtctcggagagggacgtgctttccgaggaaagggccccgagatagaagtaggaggtcttcgaagaccaggacccgcttatggatccggaatattctatgccgtcggccgtcacggtgatgtatatgttggagaatatccccacatagtccggagcatatacgacctttatgtagaatctggaattggccggcatcttcaatgtgacatcgaaattccccgacccgacctcgtggtccgggtcgttctcgtccttctgcacatatactccgccgtcctcgctctcgacgaggtgatagtcccctccggtacccgatatgacggaggatccgccgttggcatcgattacagtctccacggggaccgggattatccctatgacgttatcctggctttccaccgatgtggatgtagtggccgaatatgcggccggaacgaacatcatgaccgcgaccgccgcagatatgacggccatcacaatggagcggttcatgcacccgcctccgcggcgaatatgaaactgaaggaaggggcggaatccttccaggaatcgtccgaacttaccgggacgtctttcaaagtgatgtcgacggagatggcgtaatattccccgggtaccatgctcaatccttcgaaggacgcctttccggatacgaccgacgtctcgaggtcgtacagtgtcaccgagtacgaatcggtcccattggtcagaaccacctccagggaacttatgaagggcgggatatcggacagacccagagagacatactccccggaaccggggtccttcatcctgcactccacggagatgccgtcggatccggacgacgagatcatcagatacctgtcctccttcacagcggaaagactgtggttcggatcgctcccgacattacctttctcggaggatacgttcactgtatcccccacggtcctgtaatagatgttcgcatcggcgaaaagggtcttcccgtcggagagggtcgtgccttccgtatccgaatagatgtccaggacatagccgtcggacagcatctggtttccgctgatgtccacgctgctggtgagggaatacgcccctcccgtcaggaccagggccgaaatggccagcgtcgccactatgacaaacgcgccggaaacggtcttcatatcatgtacatcggtcggaccggtgatgcatatccccctttatccatcagacgtggagtttatagtttatataatcgacggaaaggggccggatggtgtgcactggacccacaaagcagcggtccctttctggcacatgctatgtgtgttaagttttctaaaaaacaaaatccatttgtggtttatgaagtttaaaaaataacttataaatacggtggttgacattaaccgcacccatgggaaaaagaggccccaaacaacgattcacgtatgtatcgtgccccaaccccgagtgtcccaaatactgcatgaccggggaagggaacgtagtggggaacgggacatacaaggccggaggggagaccgtccgcaagttcctgtgcaaggaatgcggccgcaccttcaacagccgcaccggcacgtcctatgaaggactgcgcacggagacgggcaaggtggatgtggccatggacttcctgtcccgcgggaagagcataagggaggcggcggaagcctcaggctgcagccagagcaccgtaaggagatgggccaacagcggggagatcgcggccatgaggaaagggtaccctcccttcgatccgttctccgagaaaggggacgtcttggataagaacgggccctcgttccttgacgacaggctccccggcatagatatgcccaaatccctcatgtacttccccgaaaaactggccaagtgcgtcaggaacatggtctcggtatacacgtgggagatcggcctcaagccccaccagctccccataataatggaggtcgggtaccacccgcacatatcccagagggatctcagcgcccgtctgcccgtggacaagtcccgcatatcgatgatcgtcaaggagctcaccgaccaggggatcgtggtgaacgagagcaacaacaagctcggttccctggccctgacggagaagggggaggagatgtacgagtcctgcaagaggatctcctgcgagacgttctccaagatcttcgacgatttcgacaaggaggagatcaaccaactagaggagtatgcttctcgcatcaaccgccgtatagacacactttcgcaggaattctccgacaggaaggacctgatgcaccgcgagaatgccaacttcggtctgacgtttcattgctaaaaatagttgatattattgatgtatgtggaaccgtccgaaaaaaaccatttactgatattttatcgaataacaataaatatctgaaatttttccattattatcaaccgcataatggtaaaataccatctaattgtatggtatttttagtttaatgataaacttataaatatcaccattccatgggcccgatcgtatgtctgctaaataaataacatacgagaacatcgacccgaaggtccgcagcacgataatggtgggccttacgctggcgatgctcatagcatgtctggacggcaccatagtcagcacatgcggtgcgacgatagccagcgagctgaacggtaccgccctgtactcctggatgatcacggcatacatgctgtgcgagaccgtgatgattcccatctctgggaaactttccgacctgtacgggaggaaccggtattcctcgtcggactggcactgttcgttgcagggtccctgctggcgggcatgtccgccagcatggagatgatgatcgcatgccgcgccctgcagggtctcggaggagggatcctgatacctgtggccaccgcggcggtggccgacctctacgaaccggccaaaagagccaggatgcagggcatgctcggtgccgtattcggcatcgggatgggtctgggaccggtcctcggtggatatataacggaatacatcggctggcactgggtattctacatcaatctgccgatggccgtgatcctgccggattccgagttctgcggcccatacggagctaagatcggctagatgaccaaaagtatacctcctgaacacactgaatcttattgtaaatcctaacttcaattgggtaccgtctggaacaggtgccaatccgactattgttctgcatattccaaacataagtaaaaagtaatggatattggcggattatccgccaatatcttttaggtttaatcgctggaggcaacaaacgatactgagaacgacacgttgctcaatgcagaagtgaggacatctatatcactggaatccaacacttccttattgatgtgtgcaacaacatcatacgatgtagtggagactccttgttcatcaaaactcagagtagatatgtccagacttacagcatcgccattgattgacacatcctcgccatctacagtgaacccgacgatgatgttctttacaacatcaacatcttcctgatcaccattggctattacagacaccttaacggacttcagttctaccccagactgcttatagacaataggtgcactacccaataggacgctgttgtcctcttcatcggcattatctccgaaagcatgtgccttcacagaaaccgactctttatacacagatcccgagccgtcatccacatattcccaagtggaagaattggaaaagataattaccttcccatccgcactgttgaatatgggtccggcgccatcgtagttgacatagatatatccgctgtctacatcattgtcgttgacattcagaatgttggttacagcataccctgcaccgatcatagaaactgcacaaagcagtaaaatcaagagagggatcagaagtttctttttaccctgattttcatcttcgctgtattgatccatatggattactccaaacaataaagaaagggggtttagaccccctctctgtttaatttcaggaagcgacaccttcaacagaagcagtcacattgaattttatcgactcaaatgcactgataatgctggaaatagtgtcatttccactcaaggctttcggactgctgtccttgagattaagagtcatctcaaaagacacagttgctccagaatcaggatttatgtctgtgatggaacgttcttcaaacttcattggatccccagagcccatgtgagcaatatcgaaaatctgagtccccagatcggtgccaccttgttttgcaacaacagttatactttccacgatatcggaaagaacatacgtagatccaacatgtatgtccccaatagagccacttacattttcaggagcatcaaccttaatcgacatggatgcagttccagtagtgtactgggaactagttatggtaacaaccattgttccgatatacgatgatttgctatcactgctgctaccgccaaattcaacagttgtagtgggaccggtaatggaaccatcgggccctgcatcgtatgtcctgtctgttacaaaggttacatcgatagaagaatcagaggaatagaatatcgcatgtgtttttccaccctctgaattcgcagtataatctatttggagatctcctccatttaaggtattcccgtttacatgaacatcggaagtgtatgcataaccgactccgatcactgcaaccgcacaaagcataatcgcaataatcggcacgattaatttcttcttgtgactgttctcgttttcacttgcgttcatttgatcaccaaaaaatagaagtggcccgaaggccacaaatgtttcaagaagccgtggtcgttacttcgaacttcacatctatgtcagaatgggtgttgatgttatccaccattgttttgacatctccggaattgaatactacgccggatatgaccgcatacatagtacattcaaccacaacatcagaagaaccagtagggatagttacgttaacattggatgagccattgataccgtttacttctgtgtaactgtagttaccatcgatcttccatacaaacacgtactcttttatgagttcggagagagtacttccattgcctagatcgatattggaagtgcttacagtgactgtaatctttgttgtatcttcaccagccctatttgacacctttacactagcatcccctaacaaagatgcttttgctccatccccgagattaaccgttacattagagattacgtcatcgtgaccgcttgcagtaattttgacagagctggaaggagatgccttgttataggtcttttcctgcacaaatatgatgtctactgaaggatctgcaaggaaagcacttccttctccatttatgtctatagataattctcctcctgctaccttgttattctcaacagtaacagaggatgaatatgcataacctgccccgatgaccgctactgcgcacagcatcagagcgatgatggggacgaggagcttcttccttttggagccgccctcatatgccccccccctaatattctccattgtttttcctccaatgatcaaacgtctgcggtagacgttgtaatgaattacaacacctatcacgcgtttatcaagctctttacattgtcatattatttaagagggtgggaaagcacaagtatacaatcaccgttaaaccacagtaactatgttgcgatcacaaatatatcctaacaatcgtgtacataggtcggccgggactgcgccgcagacggcgacatgcgtttggatcccggtgcacgtctcggccctggcacatcgggagggatcgggaccctggggccccgtgaacggtttcactttttcttcttctgcagcctctcgagtctggccttggcggcttcgtctccggagctggccgcggcggcgagcttctcctcctccgccttcttggacttggccttcctggcgagctgcttcttgctcatagccattgttgtttcgcctctgtctgcgtgtaccgtggtacattatttgtatcttttgaataggatgtcaccgggaagggacgttcccgtccatggagaagtactcctccacgaaatccgctatctcgatgtagcaggcacggccgtgctgtttcctgccgaaggcggtggcggaggcatactggctcttctcctccacccctctcgccagatggtcgaccctctccctgcggtgcccctcccagtaggccaccgcgtcgtcgatctccttctgggtcttcccgccgagggcgatctccaccccgttcctcaggtccgagaagtactccctgaacaggagtatggagcgatgtgcggaacgggggttcatccccctcctgtccttcgggtcggccaacatgtctatggccgcatcggcgtccgccgacctggctattatgtcaccgcacctgacggggacctcccttatgtccggggcgttgcccatatacccgatctggcagaagcatgcgtccatgaatatcatgaccacatgctccacggtgtcgcaggaactcatcttcgccatgaggccgtcgaagaccttctgggttatgctgccctccttcgagatctccggccatttgacctcgatctccgactctatgcgggccaccaggtttacggggcagacggaacctcccctggactccctccagcagcatccaacgacacggtcggcgatcccctggcacatgctgccgaacgccttgtcggagccgtcgaagcggtccaccgcctccgtccagaaatccaccgcgtacggtatctcccccttgtcgaacatcatgtccccgtaatggacgcacaccctccagccgtcgccgtccctgaggacgggcgcctcgaccttcggctcctcctcggcaggcttcctcttgaacagacccatttgcatatcgcccctctctatagcatctggaacatgccgtgtgtgttcataaaccctcgtcaaagaggaggaaaaaggggcccgcccctcggacgggacccctggagagaaggggaccgttcaccgcatgcgccgcccgggatcaggcggtgcgattcttcccgccgtagcggtcggcgaacttcttcttctcgggggcgtagtcgcaggtgacggtctttcctccgaagacgctgcctccgacggactcgatgacgaggtccgccgcatccgccgggacctccacgaaggacgaggccgtaccgagtccgacctttccgatatcgccctccccgagtcccgccctcttccttatgaaatcggccagctgggtcctgttgacgtcgtcgttcttcccgacgttgacctccaccaccatgcggtcgtcggacctctggggcctggcgctctccttcccggccttcttcccgcggggggccttcaccctgtccgcggatgcctgcctctccccacgctgcggcctcctctccctcctgaccggctcgtggacggtctcgaagggttctatgtcgtccacgtcgatggccctgatcctcatgccgatctcgtgctcgtagtcacggacgaaatccatgtccctcttggtggcgagtgtgagggataccccctccctgccggcgcggccggtcctgccgatcctgtggatgtaggtatccgccctggacggtgcgtcgtagttgaccaccaggtcgacgtcctcgatgtccagacccctggcggccacgtcggtggcgatcagaacgaggaccctgttgtccctgaagttcctgatgaccctctccctgagcgactggggcatgtccccgtggagggtccccgccttcgcgtcgtccctgaactcctggaacaggtcgtccaccatggtcttggtggcacagaagacgatggccttgggagtgcctttggaaaggatctccctcagcatgtccttcttctcgtccctcctgcatttgaccacgtactgcttggtgaggccggtgacggcgttcccgtcggaggcgtccacgaccgccgggtcgtcgagcatgtccttctcgagcctctcgacggcacgcgtcatggtggcgctgaacatcatggtgtgcctctccttgggcacatgttccagcacggcgtcgaggtcgtcctcgaaacccatctccatcatgcggtccgcctcgtcgatgacgacctcgctgaccctgtcgaggaccagtatccccctctcgcacatgtccctcaggcggccgggggtccccactatgatgtcggcgcccctgcggatgtcgtcggactgcctgcgcatgtccgcccctccgtacactgggacgctgcagtggccggagcgcttggacagtttcctgatctccgcatccacctgcatggcgagctccctggtgggggcgatgatgaggacggacgggaccttcgacccgggcttcgccctggtcatagtgatcatggaatatgcgccggtcttaccggtaccggtctgcgccttggctatgaggtcgcgtccttccaatccggcggggaccgcctccatctgtacgggggtgggctccgtccaacccatgtcggccgcagcccttactatatcgggggataccccgaggtcttcgaaagaagtcatttttggataccttcaaaaggcctccagaaaagaagacctgataggtggggttatgagttcaagtatttgaataggagcctccgaccgagaaaaacggcatacggccggagaagggatgttcgggaggggcggggcccctcccctttcagttcttgccgatggtctcctccgccgactggatgcacttggtgagcaccgagtaggcgttgatcatgtcgggctcgttgacgatgaagatggtgtcggtgtgacaggacacggtctcctcgatgttgatgcccgcatctgaaaggttggtgatcaggtacgcgatgacacccgcggtgtcgacgatcttctccggcgacttcacgacgatctcgacgaggttctccctcaccttgatgatgttgaacctgccgacggtatcggtgatcctctccttcagcatgcggtccgcgatgatggtgacggcggacgccgactgcacgcactgcatgatggagttctcgttccacaggtccttgaacaggttgtccatcttgtggaggacggtccagtcgttcttggccgtgacgatgcacgtcttggtcctcatctcgagcctgctgtccttcaggacgctgaggatggcgagctcgtggtcggtcgtcacgctgagcttggaggcgtagcgcctgcaggcgatcatgaccgcctcctcgttccctacctccaggtccttcattatgagacgcgccagcgaggaatagttgatgaggcctttcgctacgcagtccttgatgctcgggtgggcatcgatatagatcctggtcctctccgcgagactctcgcgggacactgtctctgccatgatgccgtaatcgtaggacaagtattaatgtcctatctcaaacaaaatgttggaaagaaacgggaaataggtttttattgtccctgaaacaggcacatacacctgtttagggacaatgtgtactcactcgagcgcggcggtgaaggccctcatgaactcgtccttctgctccatggtgaatatgagcggagggatcagtctgacggtcttcccgtgggccacgttcacgaggacctggtggtcggccatgtacttcctcacgccggccgcggtctcctcggagtccatctccacgccgattatgaagcccatcccgcggacgtccttgatctttccggggtgcttcgccttgagggcctcgaggtccttcttccaggcagcgcctacggtgctgacgttgtccaggatgtggttgcggttgatgatgtctatcaccgcgcacccactggcacatacgagggggttgccgccgaaggtggtcccgtgggtccccggggtcatgacggatgcgatctcgtcggtggtcatgatggccccgatgggcattcctgccgccagccccttcgccgtggtgatgatgtccggcacgatgccgtagttgtccatgcaccaccacttgccggtccttccgacgccggtctgcacctcgtccacgatcatgagcacaccgtagtcggtgcacaggtcgcggacgccgcggaggaactcgggggtgccgcagacgacgcccccctcaccctggatgccttcgatcaggaggcatgcggtgtccctgtcgatgagggacttcacggactccaggtcgttgtactcgaagtatccgaaggtcttctcgtttatcaggggctcgaacgtctcctggtacttcttctgggcggtggcccccagggccgcggaggtcctcccgtggaacccgttgtaggcggagagcaccttgtgcctcttggtgtagcggacggcggtcttcatcgcgccttcgttggcctccgcaccgctgttcacgaacagggtgcgggtgatggcgtcgggcgtcacggtgttgagacgctgtgccagctgtgcctgctcctccacgtagtagaggtttgaaacatgcacgaggtgcgacacctggtcgcgcatcgccttcacccagtccgggtgggagtatccgagggagcatacggctatgcccgccacggtgtcgaggtactgcttccctttcgcatcgtagagatagcacccctccccgcgctcgaaagccaggtcgaggcggccgtagttggggaagagatacttcgaactgagatccttcactgtctcgaaatccatttgaatcacttttcatcttattatcagggtcccgtgcgggatccctttgatcacgtcggtaattatactgtctgggtcttttccgttgaccatgcggacggcctccgccccggcctctatggccctgcggcaggcgtccaccttggggatcatcccgccggagatggtgccgtccgcgatgagcgcgtctatctgcttcagggtcacggtgtcgatcttggatgaggggtcgtggacgtcacggagtatgcctggcacatcggtgatggctatcatctccttcaccttgatgccggcggcgatacccgccgccatggagtcggcgttgacattgaggtgctgctccccgtcggacccgacgggatatatgaccgggacgatcctctcgtccaccaggtcgtacaccacctgcgggtccaccttgacgacctctcccacgagaccgtagtcgacctcgatctccctgccctcgtcgaccaccgtctgcgggccgtccctcctgcattcgctgaggaagtatccgggcatgcctatggccctgacgccggcgtcctcgaggcacctcacgacctcggcgttgatccctctgaggaccttctccaccacctcgaggcccgcctcgtcggtgatacgcttgccggcgaccttgacgggcttcatgccgagacgttccatctcggcgtttatggccggtcctccgccgtgcaccatgactatgctcacgccttcctcggtgagggccgcgacctccctgcagagacgttccataccgtcgtcccccagtgcgttgccgccgaacttcaggagatatatgtcgcgcatccggaccactcaggttgcgtattccgcattgatgcggacatagtcgtaggtcaggtcgcatccccagccggtggcgctctcgttcccgacgcccaggtccagctggaggatgacctccttgttgtccatggccatgcggacgacctccacggacctctcctcctggaacacgggtgccccggagtcgaggatcggaacctccatgtcccctccctttatggtcagatggacgtcgttgaggctgaagttggccccgctgttcccgagggccatcatcacacggccgtagttggggtcggacccgaagatggcggactttaccagaggggagttgattatggtcttcacgacctttctcgcgtcatccttggtctccgcaccggtgacctcgacggttatgagtttgctggcaccttcgccgtccatggcgatggtgcgggcgatcttggtcatgaccatgcgcagggcgtcgatgaaggccgggtcctcgtcggccgcctgacctccggccatcccgttggccagcatgatgcaggtgtcgttggtggactggtcgccgtcgacggacaccatgttcatggagtcgtcgagtatcgactggtagacctcgttgaacttgggggtgagcaccgcatcggtggtgatcatggtgagggtggtcccgtggagcaccttcagatggggggagatcataccgctgcccttggagatggccgagatgtaaacgagggtcccgtcgccgaggcggacgcggaccgcacactccttcttgatggtgtcggtggtcatgatggcctcgcacaggagtccgtcggcctcccttcccacgtcgagctgcttcgcggccttggagatcccgtactggatcttgtgcatgtccatgaaacgtccgatgagacccgtggacatgactccgacctccttggggtcgatgttgagctccgcggccacggccctctgcatggtctccgcatcctcgtacccgcggcgcccggtgagggcgttcgcattcccactgttcaccacgatggcggacagtttgggggagtcgtctttgatcatcatctgcacaggcgccgccttgaccttgttggaggtgaacgccttgaaggcggtcgccgggacctccgagtacagaagtcccaggtcgagggagcggtatttaactccgctgtgcaccccggccgccttgaatccctgaggggtggtgattccaccgtctattatctctaccattcttgatcacactcccagtcccgggaagtcgaggccgtcggcctccggaagtcccagcatcaggttcatgttctggaccgcctgcccggaggcgcccttgacgaggttgtcgaggactccgaaggagacgaccctgttccccaggaccttggatccgacctgggcgtggttcgaaccgaccacgtcgcggatcgacggctctggcacataatgcacgaagcgctcggccccgtactgtttctcgtagaccgcgtcgacgtcttcctgcgacgcgtccttcttcaatctgaagtagcaggaggagatgatccccctgactatgggtacgaggtggggaacgaacgccacgtccagatggctccccgcgaacatgtccaccgccatgtcgatctccggctggtgcctgtgagccccgatcttgtaggggatcacggactccccgcacgtcggatgatgcaggcgggcggacggggtcatgccggcacccgaggtgccgctcttaccgtccacgaacacgtcgtcgtgcacgagacccgacttcatcagcggtgcgatggccaggatggcggacgtcgcgtagcatccggggttggcgaccaggtcggcccccttgatcctctccctgaagagttcgggctgcccgaacacggccttctccagaccctcggggtcggagtgctccttgccgtaccactgctcgtacagggcggcgtccttcagacggtagtccccggagaggtcgatgcatttgatcccctgctcgcggagggccgggacctcctccatggccaccccgtacggggtcgccaccatcacgaagtcgaggtccttggtatcggagatcctctccgtgaacttgatgtcggtgtatcccctgaggaacccgtggaccgaggtcacgtccttccccgcgttggaacgcgaggtgagggccgccaactcgatgtccgggtgtctgcaaagcagacgggagagttcgcttccggtgtagccggtcccgccgatgatacccactctgtaggacatttggaattctcctttctatggaggaccgcccacaaataacagattaaaaaaggtattgtcctatttcagacacaaactgtcggaaccgttacggtggcaacaggcgtgaccccctgccaacggatgattcccaagagggacaagtacggaggggtccggatccgcccggacgggcgactcatatggacatccgtacgcgatggtccgaccccgtccttccctcctccgataccggaggcatgtcccgtccagacggtatcaggacatactgccccctccatcctactccgcgcgcccgagattttattatagggcgtgggatatggacgcaccatatggcagctaacaaggcagcaaacgaaaaaggcaagagggacaaggtcgtcctcgcctactccggaggtctcgacacctccgtcgacatacactggcttcaggagaactacgacgtcgacgtcgtggccatctccgtggacgtcggacagcccgagaccgacggcgaggagatcgtcgcccgcgcctacaggaacggtgcgatccgcgccgacttcttcgacgtccgcaaggaattcgtcgaggagtacgtgtggcccctggtcaaggccaacgggatgtatcaggacgtgtaccccctgagcaccgccatcgcccgcccgctcatggccaagaccctcgtcaagatcgcccacgaggagggggcgaagtacatcgcccacggatgcaccggcaaagggaacgaccaggtacgtttcgacgccggcataaaggcgcaggaccccaacctcgagatcatcgccccccagcgcgagtggatcgccagcagggacgacgagatcgactacgccgccgagcacggtatcgagatcaaggccaagaagaacagtccctactccagggacgagaacctctggggagcgtcctgcgagtgcggcgccctcgagaacgcctgggacgagcctccggagggggtatggatccacaccgtcgcccccgagaaggcacccaacacgcccacctatgtcgagatcggcttcgagaagggtatccccgtatccctggacgggaaggagatggacggcgtcgagctcatcgacagactcaacaagatcgccggggagaacggcgtcggaaggatcgaccacgtggaggacaggctcgtcggcataaagagccgcgagacctacgagtgccccgccgccgtggtcatcatcgccgcccacaaggcgatcgagagcatgaccctgcagagggaggtcctcgacttcaagaagaccctcgagcagaaattcacccgcatggtgtacgacgggcagtggttcggcggactcagggaacccatcaacgccttcatcgacaagacccaggagttcgtcaccggtaccgtccgcgtgaagctcttcaagggaagcgtcaccatcgtcggaaggaagagccccgtgtccctctacgacaccggcctcgccacctactccaaggacaccgtcgacaccttcgaccacaaggccgccatgggattcatctacgtgtggggtctgcccgaccagaccgccgccagggcccacacgcccgaaaagaagcagtgatcccgatggcaggaaaagccctctggtccggaaggttcaaggacggtatggacgacagcaccctggagttcacctcctccctggacgtggactccaaaatggcgttctacgacatcatgggttccctcgcccacgtccgtatgctgaaggcatgcaagatcatccccgcggaggacgccgacagcatagtcggcggactcaagaagctggcacatcagctggaggaaggcgggctcgacatggactactccctggaggacgtccacaccaacatggaggtcaagctgaccgagatgataggtccggccggagggaaactgcacaccgggaggagcaggaacgaccaggtggccaccgacttcaagatgtacctgagggatgccgtcctcaacgccgtcgaggcggtcaacggactcatacgttccctgcaggacgtggccaacggcaacagggacgtcatcctgcccggatacacccacatgcagcatgcccaaccggtgactctggcacatcacatgatggcccacgcgttccgcttcggcagggatgcggacaggttcctggacgccttcgagaggatgaacaagtgccccctgggatccgccgccctggcagggacgacgtaccccatagacaggaagatgacgtccgacctcctgggattccgcgaccccaccgagaactcgatggactccgtcggttccagggacttcgtgacggagatcgccttcgacgcatcgatggtcgccatatccctgtcctccctgtgcgaggaactgatcctctggaactcccaggagttcaagtacatcgagatggacgaccgctactccaccggatccagcataatgccccagaagaagaaccccgacatagcggagctcaccagaggtaagaccggcggcgtcatcggaagcctcgtggccatgctcatgaccaccaagggcctgcccctctcctataacagggacctccaggaggacaagaaacccgtcatggactccctgaagaccgtcaccgactgtgccaggatgatggccaaggtcgtatccacgataaagatcaacgagagcaggatgctggaggccaccaacagcgggttcatcaacgccaccgacctggcggactacctggtgaccaaaggcgtcccgttcagggaggcccacgggatcgtcggggagaccgtgaggtactgcatcgagaacaagatctcgctggacaacctcaccctcgaccagttcaggaagttctccccgctggtggacagcgacgtgttctccgccatagccgtcaagaactgcgtggagagaagggactcctacggaggcacatcccctgcatccaccgatgtcgagatcaccctctccatgcaggacagcatgagaagggaagaggacgtcaggatgaaggaccagctcatccagagctgctgggacaaattacttaacgagtaagacaagggcagggggagaacatccccctcccgcatggtttttcagatctgggtcataggaccccaccatctctcagccatttttccatacatttgtccgaagacgttgcggagcctccgtggacggagagacctggcatgacggccgtctccggacaacattccgcgatatccctctcgctgcgacctatgccgcccccttcgtcgatgtatataggcgatatcctcttcccagagagaccgcagccttcgagcaagatgaaaaacaagaacaacggtcgaaatggtgtctccatttatcggaccatgttaaaagagagcatgtgccagcattacgaatcctttgaaaaataaggagctataagatccggacggatgtgtcgcggaaggacggagatgatcgcccttttccggaaatgcacacacgtccggatattgccggcggagatgatcgccgactgtgagtgggagataccggtgcgccgggccgtgcggagagatgactccgcactcccagtatgacgcaccgctgaatgggaggggaccatggcagccccgctccccgaaggaagaagtttaaattcagttcttaccgaacaccttggcgaaggcctgctcgaagtcggcgatcaggtcgttgatgttctcggccccgatggagatcctgatggtggtcgggtggatgttgaccttctcgagctcctcctcggtcagctgggagtgggtggtggacgcggggtggatgatcagggacttctcgtcggcgacgttggccaggaggctgaacagggtcaggctctcggtgagcttctgggcctgctccttggtccctttgacgtcgaaggtgaagatggatccggcaccgtcggggaagtacttgttgtacagaccgtgggtggggttgtcctcgagggcaggatggctcacataggagacgtgggggttcttgctgaggtattccacgatcctgagggagttctccacctgcctgtcgacacggagggacagggactcgagggacaccagcagggcgaaggcggtgacaggcgagatggtcgcaccggtgtcgcggagcaggattgcccttatccaggtaacgaacgccccgggaccgaggctggcgaacacgacgccgtggtaggaggggtcgggctcggtcaggttagagtatttgccgtatgccttccaatcggtcttgccggactcgatgatgacaccggcgatgacggtaccgtgaccgctgatgaacttggtggcggactctacgactatgtccgcaccgtgctcgagaggcctgaagaggtagggggtcgcgaaggtgttgtcgaccacgaacgcgatcttgtgcttgtgtgcgatctcggcgatggcctcgatgtcgacgacctcggagttggggttgccgaaggtctcggcgtagatgaccttggtcttgtcggtgatggccttctcgaagttggcaggatccttggggtccacccaggtggtggtgatgccgtagttcttcagcagggtgtgctcgaagaggttgacggttcctccgtagaggttgttggccgcgacgatgttgtcgccggagagtgcgagggcggtcacggcataggtgactgcggcggctccggaggaaacggcgagggcggcggctcctccctcgagggcggcgatcctgtcctcgaagatgctctgggtggtgttggtgagcctgccgtagatgtttcctccctctttgagggcgaacctgtcggcggcctgcttggagtccttgaagacataggacgaggtcaggtagatggggacggccctggagtcggtggcgggatcgggctgctcctgtcccttgtggatctggagggtgtcgaacctgtatttgctggggttaaggggtcctgcggggatgttgtatttgtcctctacgcggaactgtttctcttctttcgatttctcggtcttgtttccgaataccatgttgattatctcctttgtcagcagcggtgcgctgcttctgattactactatgttattcctaagtacttattatctattgttaatataagtcatatcggaataaattaaaatttttattcttatcagccttcaatttttcttcgaaggaaggtcgaagagaatatcatcgtcctccgtgacgtcgaaactcactccgcccttggtgaggatctccgagacggtctccctgatcttcccgaggtccacgatcttggggttatagctctgaaggtagaactccttcctgtccagagggaacaccatccttatcctggccttcctgatgtatccttccggcttgcggttcttctccagatcgtccaggttcagctggatgatcatggtaagctcttcctcctccggcacctggtccgcgatgacgagggcggacctgagtatatccgggaagacaggcgcgaggtctttgtagtcgctcttgcctttgaggatgaagtgaacgctgctcttgtttgccatgcccgacccatttccatcaatctattaaaagatgaatcggacactctttcatattgtaataataataaaataaatattcttaaaagaaaagcacacgcccctttctataattatatacttaaatggcatggggaaagacacatgagaaccgctcttacggtggcgggttcggattcggtcggaggagcaggcatccaagcggatatcaaggccatgtcctccgtcggcgtccacgccgcctccgtcatcaccgctgtaaccgcacagaacacctgtaaggtcagcgacatattccccatgccggcagacatcgtgcaggcacagctcgacgccgtgctgtccgactgcgacataaaggcagtaaagaccggcatgctttacaacgccgagatagtaggtgtcgtcgcggataccttcgaggaccacgacatccctctgatcgtagaccccgtcatggtcgccaccgtaggcgacgacctgtacgacaagacctatgtccgtgcgctcaaggagaaacttcttccgatatgcgagctcgtcacgcccaacaggcacgaggccgaggtactcgccaatatgaggatacagaacgaggacgacgtcaccttcgcctgcgagatcatcgggaaggagggtacgtccgtccttctcaagggagggcacatgagttccgtcaacgtggtggactacctctacctgtcatcggagatcacgaggataaggaaccctcggttcccgtacaaggcaggacacgggtccggatgcacgttctccgcattcataaccgccaacatggccaacggattggacctggtgacctccgtgctggaatccaggaagatgatccagaaatccatcgagacgcagtatgccgtcggaaaaggagtccccgtggtcaacacggatgtgaccctcacgaagaaggaagactcggacaaggtcgccgtactgagggagttggacgcggccgtcgggaaggtctgcgagatcatgccgacggaactcatacccaagaccgggatgaacttcgcctacgccaagaaaggggccaaaggaccggaggagatcgcagccgtcgacaagaggatagtggtccacaacggtctcgtgaaaaagaacggacagatacggttcggcgccgccgagcatatatccttcgtcctcctggaggccatgaaggcggatcccgacatccggtgcctgatcgagttctccgcacccgaggagttcgtggagaacatggaggatgcgggactcgaggtgaccctcatcagaaagagggagggaagcatcgcggagaccgtccgtacggccatcgcatcgtccaggaagttcccggacgtccttgcggacctgtccaacaagaagaacgtgaccatcgaagtactggggaagacgcctgcggacgtcctttccaagatggacatggtcctctgagcaggcccggccttacggccggcctctcggaatatcttttcccattaccctaacttcgacagaagcatccgctgatggattctgaacgaacacatttgttactcctgatagttttggttgtgttatggcggtgacatcgatagtgacattcggagcacaccatggaaaccgggatcgtttcgtccttacctatcactcacgaacgattcatcttccgagcatccagtcgatgacgttcacgaccctgatcccgccgaaattcccgaggttgaacctgtccatcgtcagcacggtcttcgggaagttgtcccttatggcctccagagaaccgaattctcttttcttcgtctcctcggaaagaatggtcatcgcgacctgataatattcgacgtcgtttcccatcacggcggtgaaatccacctccttgccgccccgtccatcgcatgtgggaagcgattataagtgttaatctattgtgatagatttttcttcaacaatttaaaaaatatctgttacaatagatttttaggaatgagtggagtccagtccgcctctttaatagttcatttattcgttcagcaaatgatttcatcgaaaaagcagagtctgaccatcaatcaagaccgtctataagcacccattaaacactcggatcaaaaccaatatggaacatgtctgaacatgtgtgcagaagtattcccatctaccacttttaccaaattcctggatttggcgtcttagaattttatgaatcctctgactctgcaacggtgatctgtagttttcataaggtcccaatacacatatcgagtacctaaatgtcggattgatttttctacaagtatcggattgatttttctacaagtatcggattgtgtttatacctcccaatttatccgtgaatatggatgaagggacgttctcatacagaccgcgtattgtggattccgctctgaagaggaaactcagaggcaagggagctgtgttgatcgaaggtcccagatggtgcggtaagaccaccactgcggaacaagtctcgaagagcatcctgtccaccgatgatccgagtacgatcgatgcgaacaggaccctgtcggagatcgatccggagagattgctcatgggggaacaaccgagactcctggatgaatggcaggtcgcacccaaactgtgggatgcggtaagacaccatgtcgatcgccacaaaggccagggtcaattcgttcttacgggttcgtccgttcctgccgatatgtccgagaccgttcactccgagaccgggagattcggtcggatcgtcatgcgtccgatgaccctcttcgaatccggagattctacaggtgaagtgagtctcgcatccttattcgaatcacaacaggtttccggatgctccgaattggatcttgacagactggtttttctcatctgcagaggcggatggccggaatctgtggatatggacgacgacatcgcattggatcaggctttcgattacatcgatgccgtgatcaaaatcgatatgtcgcgcgtggatggcataaaaagggatccgcagaaagtgaggacgcttttacgttcatacgcaaggaatcagggaagccagatctcccaggcatcaatatccgccgacacatcatcccatgacgtgacaagtgtttcagaagagaccgtgtcagagtatctgcaggcgctcaggaaactgtatgtggtcgaggacatgaaagcatggaaccccaatctgcgttcgaagactgcaatcaggacctccgataccagatacttcgtcgatccgtccctggcagcggcatcgctaaggatcggcccccgtgacctgatgaacgacctcaatacgctgggattcttcttcgaagcacttgcggtaagagacctcagggtatatgcagaatcattggatggggacatctaccattacaaggataacctggacaacgaatgcgatatcgtcattcatctgagggatggcagatatgccttgctggaagtgaaactcggcggcgaaagactgatcgaggaaggtgttgaaacactgaaagacgttctcagaaggatagataccgacaagatgggggaacctgccttcatggcggtcgtcaccggtaccgaacgttacgcgtacaggcgcgacgatggcatattgatactcccgttgggggctctcaggaactgaaacgcccggtatggatcatgtaacggaaacgtgccgtacgaatagaaatccagaaccggaattctcgaaagaaaggatctaaaagtccagagaatggttcgtggcagatacagagatgttaaaagaagcccggagagactccgggcaatgagtttgatctcagcttacggagacgactttgatggtgaagtacaggtcgatgttgtacttctcctcgacggtcctgtactcgaaggacccgtcgttgccgagaccgatgatgtaggcgaagaagctgttgccggtatccttcgatgcggtggcatcgtacatgggcaccctgaccatcttcacggcagagtactcggcggtgttcccgtcgaaggaatcgtggaagtcggaataggtctttccgtccactgcgacggagtcggtgacggagagggtgtatttgatcttcccggcatcgatgccgtccacatggatcttgacggtcgcgaaaccggactcgatgtcgtaatcccctccgttggacgccatgttggtcaggacgatggtaccgtctgcgttcttggtgacattggcatcccatccgtacagcgtctttatggaagtaccatccgtcgcatcctcgccgtagagcgtcttgtattccgccgcggacatcttctgctggacggggacctcgaatccgttgttcgcgatggtcttggtcgtatcggcagcgttgtatccctgccctgcggggatgacgaccttcacggtgtctccggccttctttccgatcaccgcgttctcgaatccggacaggtagtttccggaaccgacggtgaatttgatcgcagagtaggaagacacctccacgtatccggccgagtggatgtacgaagtactgtcggcgatgtccttgacggtggtctggaagatcgcaccgttgccctcgccgtcgtagtagtcgtagaatgcaccagtgtagtcgacttccacggtgctgccgctggcagcctcggcatcgttgtcaccgttcagtatgttgtcgttcacaaaggcaccgatcacggccacggaggccacgatcagcactacgaggcatacgagagagatcggttcccgctctttcctcggtttgatatcttcatcatcgaccattatatctgtccgtcaatccctgccttcctataaataaagttggcttccttataatattgaagagaagtcctgtccaatccaacatacgtccccgtagcgcggatatgccggacggcggtggttcgccattattaatatcggaaaaaatctatcccgccgcatggctatttccgtggcagacatgatggaggaggtcaggaggaagaggcctctcgtacaccatatcacgaactacgtcaccgtcaacgactgtgccaacgtatgcatctgtgcgggagggtccccggtgatgaccgacgaggcgaaggacctgcccgagatggtcgccctgtcctccgccgtcgtactcaacatcggcaccctcaacgagaggaccgtcgaatccatgaccatcgccgggagggaggccaacagaaacgatgtgccagtggtcctggatccggtaggggccggcgccacatcctacaggacgtccgcggccagactcctcctggacagggtcgaggtgtccgtcatcaaagggaactccggggagataggggtactggccggaatcggcgggaaggtccgcggagtggattcggtctccggatcggacggcatggaggccgccgtctccgcactggcggagaggacgggggcggtcgtggccgccaccgggaagacggactacgtctcggacggaaggaccgtatcggtcatgggtaacggatccgacatgctcgaaacggtatccggtacgggatgcatggtgtcgtccgtcatcggatgctatgtcggagcctgcgggacctcggtggaatcggtctcggcggccatatccgtcttcaacatcgcggcggaaaaggcggtggagggcgggaaggtcttcggtcccgggtctttcaagacgaaactcctggactcggtgtacggccttaccaaagacgatgtggacggatccataaggatggaactcaggaaggtctgaaccatgttcgaactgtatgcgataacggacaggaagatgctcggaaacacctccgaggtggatgcggcgcgcctctgctacgagggcggggcggacgtcgtacagctgaggatgaaggatgcggacggcggagagatgctggaggtcgccaaggagatggaggccctcgcaaacgaatacaacaggttcttcatcgtcaacgacaggatagacatagccatgctggcacatgccgacggcgtccatctgggacagaccgatatccccctgagggaggccagaaggctcgtgggcgacgacatgatcatagggataagcgtggacaacgccgagcaggcgagggaggccttggacggcggtgcggattacatagctgtaggctccatattcaccacatccaccaaaccggatgccgcacaggccctgggtctcgacgccatattcgacataaggagggagatcggcgacgaggtccccctggtggccataggcgggatcaacagagggaacatactggatgtcatccatgcgggagccgacggggcggcggtcgtatcggcgatcatggcacagcccgacataaagggggccgcccacgagctgaagaccatgatcctcaacgacaggaggatgcgcctctgatcgccaacgggaaggatgtcggggacccggaagggaaaagcgtcgcctcgtggctctccgataacggatacgacatccccaagacggcggtcctcctgaacgggaagatcgtccccagggacaggatggaatccaccgcgctcaaggaaagcgacacgatggagatagtcagtttcgtgggcggaggatgatgagggtaacggtcaacggcgtcctcacggacaccgattccaagacaataggggaactgggacaccgtctctacccggaccgcggcatagccgtggcggacggaaggcaggtccccgcggacacgatcctcgaagaaggcatgaccatatacttcggagaggggaaggacatgcgcgccgccatgctgaaacgcgatgacccagacgtcgaatcccatatgtcgggggcctgcgtcggcatagccggactgggcggtcttgggtccaacatagccgccatgctggcacgtacaggggtgggaaggctggtcatagcggatttcgactgcgtggaccttagcaacctcaaccgccagaactacttcgtggaggacctgggtcttgcgaagacggatgccacggagaaaatactgaaaaggatgtcccccttcaccgagatagagaaacacaccgtcagactgaccccggagaacatccccgggatcttcgggatgtgcgacgtcgtatgcgaggcgttcgacgcggccgaccagaaggccatgatcgtatcgacgatgatggagaggctccccgacatacccttggtcagcggaagcggcatggccggtgccggagacgccaactcgataaccaccaagacggtgctgggtcatgtggtcctgtgcggtgacggcaaggaggacgggaacatccccccgcacctgatggcaccccgcgtgaacgtatgcgccggacatatggccaatgcggtcataaggacactaacggacaagaaggattgaacaatgtcagacgacctgataatcggtaacagacacttcggatcgagattcatcctcggatccggaaaattctccctggacatgacccgcaaggtcatcgagaagggaggggtggagatagccaccctcgccgtccgccgcgtcaacagcggcggacaggagaacgtcctcgactacatgccggaaggggtcacgctcctgcccaacacgtccggggcgaggaacgccgaggaggccctgaccatcgcccaactggcgagggagctcggatgcggggacatgataaagatcgagatagtccgcgacacgaggtatctccttcccgacaacgccgagacgataaaagcggtggaactgctcacggacgacggattcaccgccctcccctacatgatgcccgacctcacggcggccaggagcatggccgatgcgggggcggccgccataatgcccctcgcggcccccatcgggagcaacaggggtctcctcaccagggatttcataaagatgatggtggacgagatcgacctcccgataatcgtggatgccgggatcggacgtccgtcccaggcatgcgaagcgatggagatgggatgtgccgcggtcatggccaacaccgccatagccaccgcctccgacgtcccggccatggccgaggcgttcaaaatggccatagaggccgggaggaaggcctacctcgcgggtcccgggagggtcctgaaagaccgcggagaggcctccagccccctgaccggattcctgggtgagtgatatgccgtacagggcgcctaccgacgcctgcgcgtacatgccccacatggaggccatagacagttccgtcatggatgagatattggaggccgagaagggcttcgacccctcttcctacacatctgccgacgtcctgagggccatatccaaggaccgtctcgacccgtacgacttcggcgccctgctctcccccgcggccgcaccctacctggagatgatggccaagaaggcgcagaggctcaccagggagcatttcgggaacaccgtgtgcatgttcacacccatctactgctccaactactgcgacaaccgctgcgtatactgcgggttcaaccacgacaacgtcatcaagagggcgaggctgaccccggaggaggtggaggtcgagatgtccaacatcgcttccaccggcctcaccgacatactgatcctgaccggggagtcgaggacgtattcggacccggaatacatcgccatgtgcatccgcaccgcgaagaagcacttctcgtcgatcggattggaggtgtaccccctcaacagcgacgagtacggatacatgcacgaatgcggggcggattacgtgaccgtcttccaggagacctacgaccccgtcagatacgaacagctccacaaaggaggggccaagaggatcttctcataccgcatcaacgcccaggagagggccctcattggaggcatgagaggggtggccttcggagcccttctgggtcttcgcgaggattggaggaaggacgcattcagctgcggaatgcacggatatctgctgcagaggaagtatccttgggcggagatatcctactccctccccagactgagaccctgcagcagccacaaggaggacgacacctccgtcggcgagagggacctgctgcaggtcgccatggcctacaggctgttcatgccgttcgccggcgagaccatatccaccagggaggtacctcgcttccgcgacggaatagtgaacatatgcgcaacaaagatttcagcagggacgtccgttcgcataggcgggcacagcgacgtcaaggaccagggagacggacagttcgacctctccgacacgagaggtgtggacgaagtacgcgagaccctcaaaaggatggggctgcagcccgtattcaacgactacgtgagatcggaccgatgaagatcatctcagttacagacaggaagaactgcataaggccgctggaagaacaggtagaactcatctgcaaagcgggggtcgacatggtcgtcctacgcgagaaggacatgccccctgaagactacctcgcactggccgacagcataagaaggatatgtgccagatatgagacggagttctgcatcaacgggttcaccgacattgcgagggacctgggtgtgggcaccgtatgggtgtcgttccccagcataaccgagagcggaaggctggatttccccaaagtaggggtatccgtgcattccgtcggggaggtcgacgtggccgagaacctgggtgccggattcataatattcggcaacgtcttcgagacgtcctgtaagcccgggaaaccggcagcaggcttggaggaactctcccgcatatgctgtaaatccgatgtgccagtatatgcgatcggcggcatgtgtccggagaacgcttccgcggcatccgacgccggtgcggccgggatctgcatgatgtccgggctcatggcggcaccggacccggccgccgtcatcgaggccgtcagaagagtctgagtccctccgtcacctcgtcgatggccatgtccgtatccggccccagacctacgcatgtaggggtcatgggtgcgacctgggtaagtcccgcatcgaccatgagggaggcgaacacgcccttgccgggggcacgtttcagaacgtcctccaactcacccaggctgtccgccctcagaatcaccaccctccgaccgcacgcctcccatttggcgaacgcctcgggacagttcttctccgcatccagtgcgcacgccaccgcggcatggcaagcctgggaggcgatcttccccttggacatacccaggtcgtgcctcatgacgacgaccagtttcatgacttccgtgacatctatctgtgtcatgaacaggtcttcgccgtcaaaggattaagaaccggcgtactacatgtaataggttaatatcagagcatcttgagatcgcccgttatcttgtcgatcacggactgcttctccggcccgattcccagacatgtgtaggtcccgggatccacctccgtcctgccggcatcgcaaactatgctgtttgttatgccctgctggtccgcgatggccttgaactcgaaaagggccctctcgccctccaccttcagaacggcgatcttctgtccgcaaccgtcccattcggcgaaggcggacggattcttcttcttcgatgcaagggcgcatgccaccgcggcatggcacgcctgggcggcggacttcccctttgacatcttcacatcctgtctcatgaggatgacgaccttgtattccgaatccctgtcgaagaaggacatgcctcctcgattgacacctcacttataaatgatggcgtcgcgcacaccgtatctccataataaggtccgatacgaccaatcgctatatacctccgaattatacggtgatgcatgttctcccgtccccccaaggcgaaaggtccggaggagatggtccgtcaggctgacgagtaccgtatcggcaacacggtggagcagtccttcaccaccgccttctccctctaccgcaaggccgcttccaaagggtatgcccgcgcccaatacctcctggggacgatgtatgagagcggacacgggatccagcaatcctaccgcgaggccgccaaatggtatgagaaggccgcggagaacgacgacctcgacgggatgtgctcactcgctttcctctacgaatcgggtctgggcgtcaaaaggtcccgttcgtatgcgatagagatgtacgagaaggcggccatagccgggaacgcacgcgcccaatccaatctgggtctcatatacatggatccgaccggggccgaacacagcgaccatgcggcggtgacatggttccagaaagggaacctcggcggcaacgcctctgcgcagaccaatctgggaaggatgtacgagaagggactggaggtcaaacgctcgtgcgagacggcgtccgtcctcttcaagaaagcggccaaacaggggaacaccgccgccaagaggttcctcgcgggattatacctcttcggactgggggtggaccggtccgagaccgtggcaagacacctctatctggaggccgccagatggggggacagatatgcgatggcggaactcgagagggaggccgaacccgacgagagctacatgccctcccttaagaagaccgacgacccgggcagacagctcctgtatgggctggcctacctcgacggggtacgtaccgggaactccgtggccaccgccatgtattggctcgagcagtccgccaaggccgggaacaccacggccatgtacgtgttggggcagatctacgagaacggatactgtaccgagaagtccccgaggacggccgcaaaatggtacagatggggtgcggacaaggggaacggtccctgcgcctacaatctggcatatctctacgagagcgggaccggcctcgataggtcggataacctcgccttcgagttctacaggaaggcatcgggatcggaatgcgacgacgatgccaagtcggacgcactcttcgccctcggatccatgtacgccgacggcataggtacggaaagatcctacgatctggcactttccaccataaaggcgtccgcggacctcggacacgcaggggcccagttcgccgtgggtaagcttctgctcaagagaaaggacgatacggaggccgccagatatctgaggatggccgcagaccagggtgacgggcgcgccctcgagctgctctccgccatggattgacaacaactgcgcggcggcgtcacaatctcctttttaagccggttcgcgattagtaggcatatggcacaggtcgacatcgtctactatcactccggggagcctgtccctccggcgggaacggagatcagaaggaagagcatcaaggagatggaggagtatatggaacatctcgtgatggagatgaaattcgccggggtgtccaccaagttcgagtccgtacagagggacgggaagaacgacgtggtcgtcaacggaaggaccgccgcccagatcctcgacggtctggagatcaggaaaccggaactccagggcgatgcggaggtatatcccataatcaagttcgagagggcccccgaggactggaacaccgatttcatcgaggacatctccgacatactgatgaagaacgtcctctccaaggctttcgccgactcggagaagctccgcatcaaggagctcaggacccagatggaccaggaatgacctgccttctccgatacggggccgccgacatgtcggcggctaccattcatttataaggcggacgccaatccccgacacaatgtttgagatcaccaaaagagacgggatggcccgcataggcaagttcaccaccacgtccgggcgcaccatcgagacgcccgccctgcttcccgtcatcaatcccaagatcaagaccgtcacacccagggaactctacgacgagttcggcttcggtgcgatgatcaccaactcgtacatcatcaagaacacacccgcactgaaggaggaggcccaatccaaaggtctccacgagatgctggattatcctgggatcataatgacggattccggaaccttccaaagccacatgtacggggaggtggagctcaccaacaaggagatcgtggagttccagagatcgataggcaccgatataggtaccgtcctcgacatattcaccgagccgttctggaccaaggaacagaccgccgaatccatagtggagaccctcaaaaggaccgaggaggccgtctccctgaagggggagatgatgatcaacggggtcatccagggatccgtcttccccgacctcagggaggactgtgccaggaaactcgccgagatggatatcgacgtccatccgataggtggtgtcgtccccctgatggagcagtaccgctactcggagctggtcgacgtcatcgtatcatccaagatggggctcaaccccaaccgtccggtccacctgttcggagcgggacacccgatgatcctcgccttcgcgaccctcatgggatgcgacctcttcgactccgcatcgtacgccaagttcgccaaggacgacaggatgatgttcatcgacgggacgttcagactccaggatatgcagtccctcgactgcaactgccccgcatgccgcggcatgaccctcgagaccctgaagaagaccgagaagaacgagaggataaggatcatcgcgagacacaacctgtatcagatcaaacaggagctttccctggtgaagaggtacctccgcgaaggacgcctctgggagttggcggaggtcagatgcagggcccacccggccatgctcgacggcctcaggaaactcagggagtaccaggacttcatggagagattcgatccgatatccagggagagtgccatattctacaccgggatcgagacccgcggaagacccgtcttcaagaggtatgacgacaggatcatgacccgctacatccctccgacgaagaaggccgccctgttctacggcggacagaacaagccttacagcagattcttcgtatcggacttcgtcaatgccaggagacagggctacacccccgtcgtcatctccccgttcgggcccgtcccggcggaactggacgagatgtatcccatcgcccagtccatgttcccttccatagaggacaccgacacggagaacgagagcgacgaactctccctcgcgttcctcgagaagcacttcacggagggcgtcgtcaacggaagcgacctggaacccgaatacaacggggagcccacggacgaggagataaaggacaacgacacgaagagggtctgggccgtggcgagataccagttcgggatcgaggcggccgaagccctgctgaagggagaactgacgttcaggaagagcaggaagaccggaaagatcaggaacgtcttctccgacggggagcatgtcctgtccatgagggcgggcgacggtttcttcaccctgaggatggagggggcgaagaggatcgtcgagaacatccccgccccccgcatgagggtacaggtcgcggacgatgcggtaccgttcatatcccagggaaggaacgcattctgccagttcgtcaccgcggtggacgaggaactggtgccgatggacgaggcgatcatcgtcgataaggacgacaggcccgtcggtaccgggaagatgctccttgtcaagaacgagatattctccatgaagaagggtatcgccgtcaagacccgcaccggttccgacgaggacaaagacgagtgacggagggtatcgaccctccctcctcaaacatcttaattagttcatttatagttcattggttcaaacaaatggttttaacccccatatgtgatactataaaccaataaatgaaccgatttgcagtactgcatgcagtacatgggttcataaagaaaggtgtagcgtatgcggatcatgactgcaggattcgacatccccgacatatctgccgtgatctcgagagagatctcaaaaggagaatccgataatctcgaattcaaggtatccaaaccatccaaggacgataaatatgtcaagaccgcgatagcgttcgccaacggttctggaggaaggatcctcttcggggtcgacgaccggggcgatgtgtcagggataccggatgacgaggtgttcaagaccagggattccatcacacaggccctgaacgactccatcgaaccgcagatatcgttcgacgtatgtatcgtgaacatagaaggaaagaatgtcatcgtggccgagttcgtcccgggaaagaacaccccctatcacctcaaaggccgcgacatagatgctggcacatatgtccgcataaacgccatcacggttccggccgactccgggaccatccgttccctcatggccaacggcgagaacatgtacttcgactccttggaacagaattccatggaggtgacggaaaaagagtcggagagactgtgccacaggatattcggtatgaatgcggagataaactccctgataaatgcagggatcctgataaacgtcccgcatggatacaaggccacccgcgcatacgctctcctgaccgagaacccattcccttatgcggccgtccactgcatccgcttccatgggaacgatgcgatattcgtggacgagagcagggatctgaccgacgacctgttcgatcagatcgacggcgcgaccgatttcatagccaaccgcatcttccgctatttcgagatggacgacagacagctgcaccgtatcgaccgctacgagataccgctgatcgcattcagggaggccgtcgtcaatgccgtactgcacagggactacttcctggactcattctccatattcgtccgcgtgttcgatgacagggtcgagatagaatcccctggaacaccttacaaacttagtctggaacagaccttgtccggatactcgtccataaggaatcccatactgatgtccgttttcaaaagaaggggatatgtggaaggctacgggaccgggataaggaagatgatccgcgcctgcgaggagaacggatcgttcgaacccaggttcgaaatcgaccatcagcatttcaaagtaacattcccccgcggaaagaaggtaccggacgagatactggaagaggatgagaacgccgtcatggagctcataaaaagcgacggagggataacccagaccgccatatcggaaaggaccggcatagagctgtccaaggtgaagaggatcacgctggcacttcagcagaagaaactcatcatgcgttccgggagcagacgcagcggctgttggcttctgaatcccgagatctcctacggacctcgcagatgaatctcattctatgctcttaccgaggttgtatgcctgcatgaatgccggggattcgaggacggtgttgggttcggtggtcgatgtggcacatacatgccccttcaactctacgccctgaaggcatctgacccatccggaaacccccttgagaggtccgtccacagcagtctggctctcgtcggaacacgtcatgagcacataggtctccctgatcgcattctctgtacagaacagacagttggcacggtctatgagggtcttcatctgccccggcatctcgtaatagtatatgggggcggcccacacgatgacctcggacctcgccatcttatcgacgatcgcattggcgtcgtccctgatgttgcagcgacccgtcttctggcacatgccgcatccgttgcagaacgcgatcctcttccccttgagggagacgaactcgacctcgttcccggcctccttggcccctttctcgaactcgtgtgcgaggatctccgagttgctgtccttcctgaggcttgtagagattatgaggatcttcttggccatctgtatcgctccttccgtatcgcatcggtacgcataaaaagttacgtacgtacttatccggacctctcctccgatccggaggagtcttccgataccaggcctgcggcgtcctctgcgacctttatgcatgccatgaggtcgtccgcggtattgcggagtctgccggcgttctccgccgacatcctgtagattatggtgtttccctcgagcctcgcctccacatatcccccgttctccggggatacggcggagaggaccgattccgcggtcctcccgtcggcatattggaaacgaagctcgagttccagcaaggccctcacttcttctggttgaggatgaagtccaccatggccttgccgacctcctcggtcctcagcttgccgccgaggtcgggggtgacctgcatggtgtcgaggcaatgcctcacggccgcatggagcatcctgccttcttcggggaatccctggttgtcgaggagcatctcggcggcgaggaccgcggcgatggggttcgccttgccctggccggcgatgtccggagcggacccgtggatgggctcgaacatgctgagaccgtgcgggttgatgttcccgctgccacccattccgagtcctccctgcagctgtgcaccgaggtcggtgagtatgtccccgaagaggttggggaccgccacggtgccgaaggtctcgggacggacgatcatggccatgctcatcgcgtcgacgaacatgaaatcgagcttcatcccgtactcgtcggccttctgctggaagatctccctctgcatcccgtagttgttggtgatgacattggccttgtccacgagggtgaccttgtcctctcccctcgcctgcgcatacttgaaggcgtagtcggcgaaacgggtcacacccttcctggagaggagaccgacctctatggagtattcgtcgtcctccgaaggctccgctttgatgtcgaatcccatgtcgtaggactccctcttgacccctatctccgccctgtatccgttgtccttcctgagcttcgccccgagacccatgtagaagtcctcggtgttctccctgaggaagtggatgtcgaagggcacctccctcttgagagggacgtacgggaaccaggaggtgacggggcggaggtttatgtactggtcgaagaccgccctcatcttgaggaggatgcctccttccagtatcccgggtttgatcctcgggtccccgatggccccgaagtagatcgcatccttctttttcaggtcggagatgtcctggtcagtgaggagctccccggtctcgagatacctctgccctccgatgttgaagagttctccgtcgaaatcgaagctggagatctcgcagagggcctccatgcagtcggtcccgaccttgacgacctcgggtccgataccgtccccggggacgatggcgaagtgcttcagaatctcccctccttgaccaggttgacgatgccgccggcatcgatgagctgggcgatgaaaggcggatatttctcgaacgtccactgctcgccggaggtctcgtcggtgacggtcccgtcgccgatgctcaccttcaccacgtcaccctccttcgcatcggtcttgcactccaccaggaggagaccgatgttcatcgagttcctgtagaagatgcgggcaaaggactcggccactatgcagctgaatcccgcctccatcagggacaggggggcgtgctccctggaggagccgcacccgaagttcttcccagcgaccaggatgtcgcccttccctaccatgggcccgaagccgggccttaccttctcgaatatgaagtcgttgagatggtcgaggttcgtggatacgagacgctcggccggtatgatctggtcggtatcgacgtcgtcgccgaacctccatacctttccttccactgtcttggacaccattcagttcccctccagctgtgcgggcgtgactatcttcccggcgatggcggatgccgccaccacctcaggacctgcgaggtagacctcggaggccttgtcccccatgcgcccgatgaagttcctgttggtgctggagaccgccctctcgccggccgccaggatgcccatgtatcctccgaggcaggcaccgcaggtgggacctgatacgaacgctccggcatccaggaatatgtccatcagaccttcgtccaccatggccctgtagaccctctgggaagcggggacgacgataaagcggaccccgtcggcgaccttccttcccttgattatctccgcggcgaccctcatgtcctcgatacggccgttggtacagctgccgaggtaggcctggtcgatcttcacgtcgacgtccttcaccgcatgtccgttgctgggcagatgcgggaacgcgaccatggactccagctcggagaggtcgtatttcaggacgcggcagtactgcgcgtcgggatctgcctccacgggggtgtagtcccctcttacgaagtccttgatgtactcctcggtcttgtcgtcgcaagggaatatgcccgccttcccgccggcctcgatcgccatgttggacacggcgagcctgtcggggaccgacatgttgtgcacaccctccccgcagaactcgaaggccttgtagttggccccgtccaccccgatgtcggagatgatcttcaggatcaggtcctttcctccgacatgtttcctgaactttccggtcagttccaccttgatggactcggggaccttgaaccacagtttcccggtggcgaacacgaccccggcctcggtggagccgataccggtggagagggcgttgacggcaccgtacgtgcaggtgtgggaatcggcccctacgatgagtctcccgggagcggcgaacccctcctccaccatcagctggtggcagacgccgcccttcccgatctcgaagtagttggggaggtcgtgtttcctcacgaagtccctcatctccttggcctgcaccgcggatgcgatgtccttgttagggacgtaatggtcggggatgaggaccatcctctccttgaacatcttgccgttgtttatctcgtcgtatttcctgaaagctatggggccggtgacatcgttcaccatgacgaaatcgacgtcggccaccacgatctgtccggccttcgcatcggtgtgcgaatgctcggacaggatcttctctgcgattgtctttcccatttagcattccttcttatcgtgtttcacgcgggcgaaatccctgtttatggccgccatggtggcatccacggacgtctcgacgatgtccataccgacggccctgccgaaggatatgttcccgtcgttctggacgttcttcatcgtcaccgcgacctgacacatggagtcgctctcgccggttatggcggacagcttgtactcctccatcgtcatgttgctgttgacggccttccttatcgcgttgacggccgcgtttaccggccctacgccggtatcggcgacggtcaccttgctgccatcggccttggttatggtcacggtggccgtgggggtcgtggacctgccggtgatgaccgtcagctcgtccaggacgcactccttcctctcggtggacttcttccacattatgtcgtcggcgatggccatcagttccgcgtctgtgatctccttcccgctgatggacatcttcttcacggcttccatcagctcgtcgatgtgctccgcagggaatttgacgcccatctcctccagcttcccctcgaccgcatgggatccggacagctttccgaccaccagacgcctctttgcgcccaccacctcgggcaggaacggctcataggtggcggtgttgttcattatgccatggacatgtatcccggactcgtgggcgaaggcgttcctccctacgatgggcttgttggcggccatggagaacccggttatcctctcgatcagtgcggaggtctccgagatcttgctcaggtcgtatgtcttcacgccgtaattggcgaacaggttgacggcgacctcctccagggcgacgttgccggtcctctcgccgaaaccgttgacgcatccctggacgatcgtggccccgttctccaccgcggccagggaattggccagggccagtcccatatcgttgtggcaatggacggagatcgggatcttcagggtcttatgcagctccgcgatcatgttcccgtatgccttggggatgatcacaccgacggtgtccgggatgttgacggaggaggccccggcctcctggacggccagcaggatctccttcatgaagtccatcctggacctggtcgcatcctcgcaggagaacatgacctccaggccgtgctccctggcatactccaccgcatcgacggccctctccttgacctgctcgggggtcatcttcagcttgtactgcatatgcaggtcggatgtggcgatgaacgtgtggatgtaatccaggccggagtctatgaccgcgtctatatccttgtggacggaacgggccagagaacatacggtcgcgttcaggttcaggtcctttatctgtctcagggtctccttctcgatgtcgctggaagcggcgaaccctgcctctattatgtcggtaccgaggctgtcgagggcctgtgcgatgcgtactttgtcatccgggctcagtgcgattcccggggcctgctcgccgtccctcagcgtggtatcgaagatcttgacatctttgatgggtcccacaccagagagcgcaagctggttgtacggacttatcgcgaacatctcttccaacttttgagcgctttcactggtttgttgagtcatgttaaaaccaccaaaccgttctccgctccgctgatcttactcgagaagaagaaggtctgcggaatcggtgaagatcattttcgaatctccttgaacggtaagaatgccatcggtttatgttataaatattattgcacgggaacgcgcgggcacgcacgcgaggaaacataaaatacgcatacggccggaatgtagcgaccggcattggaaataaaatatctggcacatgccgtgggcggggcttatgccccgcctgtacggtcatttgccgtcggtgtcccgatccttgtctggcacatcggatctgaattccacggtgatcctcttctccttgaccggggtcccgtcgggggagacctcgggttcgggttcgggactgtccttctcgtctatgaactcgatctgtaccctgctctcgtgctcggccttcttcttggccttcttctcctccttgagggctttactggaggacttgtactcgtcacggtacctggcgatgagggccttcctcttctcgacctccgcctgggtcttctccttctcggcgggacggtcttccttggggacggctttcagggcctgcttgcgttcgtccctgtacttcctgagcgcgaccttctcgtgctcgtacctgttcttcttggcctcgacctcctgctccttggatttggccatctgtttatgccgggctgtagccttcggctcatatttctccgccatttcgaacacctcgggatgtcatcccgcaacctaacgaaaataagagacaccagataaataatgctcgcaggaccgcgataataggattggataatggtatgttccgggcatccctgcccggaaatatgtttactggtaggtccagatgccgtgcttgttgcacagttcccaggcgatgaccttcttggcatcggtcttgaagaacgcctcgggcttgtctccgggcttgaggtacttcctcatgaggatcccgtcggcgcagatctcgatgaagacgatgtagtggtcgggctccatggggtgtgccgcggacttccctaccttcacgaggaccccgccgtcgaccttctcgatgtaagggacgtgcttgttctcgtcgggatcggcggtctgcgcctcgagctttaccataggctctccgcagcagacgggagtgcagtcgcatcctgccgcatagtccttctcgatgatctctccgcacttggcgcatttgtagaactcgatctttcctgccatggttgttaccaggatatgaatcgtactactctcttttaatactattatccgaaaaagcagatatgccgtactgggacacaggttctcattgtctggcttacaaaaatgtcgaaaaacgggcatacagtgtagtatatatactaaacataacgtagtgaaggaatacccctaatcgggatggagatgctataaatggcaaatttcaaactagatgcaaagatgatggggctcctgaccttcatcggttccgtcatcgttattgttgcggcattcctcacatggataacctacgagggagtgctgacagggaccaccaattacggcggaatgaaccttggagactacaccgacggctggcaggccaacataccccttatctccctcatactggcggtcataatgatcgtcgttgagatcgtcgactacatgaaacccgagatgcttgcgaagtacgtttccatcatcgtgttcgtcctctcgctcgtcatcctcgtcctcggtatcctgttcatcacctgggatatcttcggaaccctcgccaccgccggcatcaccgtcgcggaggtaaaggtcggaatgggatgctacgtcgccatcatcggtgccgccatctccctgatcctcagcatcggacaggccttcgaggcgttcaagaagctcgccaacaagaactgataaactgatttacactgggtccggaagtaaaaaaccggacccgaacatgcttttacaccgtttttcgtttgttacaatgattcgtcatatcaatcggcaatgttatattgtttgtagttgacatatcaactcgtccttaatcggatgggagaaatgttagtgataagatcggattctagaatgacgaacctgctcaccatagcagggatagtgctcatcgcagtcgccatcttcagacatggggcacattcggaaccgtcagcaagaccggtttcgacataagcagcctcaaaacgacgaacgactgggagaaatccattccttggatagtgtccatcatcgaagcggccctgctcttgttgaagaccgcatcggtcatcatgcctagccctgccggaagagacagactgttcatgcttgtgatcttctcgttgatggccgtcgcggtgatcgccctatgcctgctgttccagaattggatcatggtcaaagggagcggcgtacatgcaggtgcaggagtatggatggcgatcctcggagcgatcatatgtctggccgtcaacgccgtggagatacctgccgccatgaatgaaggcacgaaaacagactgacccaaacaatgacccgggaatacccgggtcgaaaactttacttcgaacgatacagaactcgcggtcgccctctgccgcgtttttaaatgaatataaaggactaactattaagaaccccgtaaacgattacgggaaaattagggggattagtggacatgctatattctgtcgtttcaaaagatttcatcgagaaggtggaatcgattggaaggtgcttccccaacgaatacaactccagatacgaccctgcacccgcccagacgtccagagggtatacggacgacggcccctgcggggaggaggacggtccgaccctctacatcgtgaccggtcctggaggcgccgggaaatcatccgccgtcgtgagcacgggtctggaccgcgcctgcgacatgaggatgatatcgtgcaacaactatgagagatgccttaccgacaaggagaacagtctgaaattcgcaagggaacaatgcatgtccctcagccagagtctcgtcaagatcggcatcacattcgggatagaatgcccctgcacggacgacagcaccctgcgtctggcacaacagactgcgaagaacgattaccgcatatcgttcgtatacatggcgatatgcggaccggagatcggattcggcaggaagctcaggtcgggaaacagcttcatagggtgcaattgggaagaggaatacaatggatactacaactccctgaaactcctggacaagttcatggatatcgccgacgaagcatccgtcttcgacaacagcggcagttcccccgtcctgcagttcataaagaaggacaaaaagtactacgccgcacccgagaggtatcaggccgaatggctcttcccgtatgtgaaacatgcatcgaaccagaggataacatacatccccaaggacatccctcttttcaagaagggataaatgtacgtcccgcatgatatgagtctcgcagagggatggagaacatggacataccgatcatctatggaatggtgaataacgggacagtatgcgcaggccccgtatcttacgacggacggaacttctccttgacggagaccgtgccactgtcgtccatagactccctcaaaccgagaaaatccagagggaccgtcgtgctggccgatgccgggagcctttcctccggacgtttcgtaccgcagttcgtggaaagatgcaaggtccctggaaacgacgtctggctcatcgaatccgtatacgacgagtcggacatattggacgccttcctcccgggcctggagaaactggtgatccccatccataccgtcatggacgattcggttctggagacggccatagacatatccggcgactgcataccttttatcgtatgccgcgagggaaaagccctcggcagataccgcgatccgacggaaaggataggaaaactatgtgccatgggattcgggaccgtcatggtggccgacctggacggatcgataggcgaggacgtctggcacatcatgtccgaccattgcaggaccatcccgtactgtccctgttcccggtaccctgatacggaggacagggcggtcgacgtgttcccgttcgtatcgaggagatccctgcggtgaactccccggccttcctctcgtaataggccgtatccccggaatccgttcctccgagacatagctcccccgcccattccatcccgaccgttgcggagaatgccttcaatatcgacaccgtgttggagaatctgggactttcgcttcctccgcacatcatggcggcgcagcgggacgggtgcgcacctttgcggtaccaataagggttgaaacggtcgacgaccgtcttaaggaccgacgacggaccgctgaactggatgggcgtcgccaggatcagcaggtccgcaccctcgaacagggagtatacctcccccatatcgtcgtctatgacgcaacggccgtccttcctgcatcccagacagccgttgcagtgacggacatccatgtcatacggacgcaggacgtcgacgtcccatccatcggaggacagggccctctccgcaccctggcacatcgcattggtgaaaccttccctgttaccgctcccgcataggatcagggccttcatggcactctatcggatggacggcttttatagtttcagatgatatggagacgtggtgataccatggcgggggaattcacgaaggccaggaccatgaactttccaaggacgacagtattcggtcacaatgtcctggaacagacggccgacatctgccgctccctccttttcggtgaggacggcataatcatcaccggcaggaacacctacgaagctgccgggaaacaggtggaagaccttgtttccgagcatttcaacgtggcccccgtattcacggacggatgcgaccatgacaatgtggagaaggcgaaggccgcggcgaaggagatgcgttcaacgttcatcctcgccatcggcggcggcagcaagatcgacaccgccaaactcgtctcgaacgacctcggcatacctttcgtcagcatccccacgtccatagcccacgacggcatctgctcggacagggcatccatgaagaacgaggaaggggcacccctcaccatccaggcatgtccccccatggccgtcatagccgatacgggcgtccttgtgaaggcaccgtacagattcctcgcatccggatgcgcggacgtcatatccaacatgaccgccctcaaggactgggatttcgccaggaagataaaggacgaggaattcagcacatccgcatacacgatggcacactatgccgcggagagcctcataaacaactccacactcataaaacccggactggaggagagcatatggctcgtcctcaaacccgtgatagcatcaggggtttccatgtgcatagccggaagttccagacctaccagcggttccgagcacatgttctcccacgcactcgacctgctgcacccgggaaaggccctccacggggagcaatgcggggtcggatgcataatgatgatgtgcctccacggaggcgactggaaacagatacgcgatgctctgaagaatatcggggcccccacaacggccgccgaactcggactgtcctccgacgatgtggtcgatgccctcgtggcggccaacaaagtgaggaaggacaggttcaccattctcggagagaacggacttacgcgcaacgcggcactaaacctcgcccgtactacgggcgtcatctgagatgaaaaaatgatacagctaactctagtcagcgaagatctggccaaagaagaaaacaggttcatctatctcggaccgcagctcgaatgcaaaggctgcaaagtgaaggacatatgcctgaacctcgagaaaggatccgaatacaggatcaaaaagctcaggaaacccacccatgactgcgatatgatcgaggggctcgtccacgtcgtcgaggtcgagaaggtctccagaaaggccgtggtcgagaagaagatcgccatggagggatccaggatctccttccagccctcggaatgcggacaggtcggatgccctcatttctacgaatgcaaccctacaggggtcgatgccggcaccaaggtctccatagagaccgtcggcgagaaggcggaatgcccgatcgggcagagcaggaccttggtcaccatcatgtgaccgggtcttttgaaacacggaagacaataggggggaccggatgggtccggtcccgaccaaaaccccggccataaggccgggatgaggttttatcagaatttctcgccggtgatgcgctcgtacatgtcgacgtagagcttgctcacgcggtcgacgatctcctgcggaagcgcaggtatgtcgggctcgggaagtcccttctcccttgcatcataaagggccttgtgatatccggtctcgcggtagtactggcggacgaactccttggaaagctctacgatgtttcctttggcgtactcctccgcatcccaccagcggtcctcgtcgagggtcccgaaggtgtcgatgaccatgagtttcctctccttgtcgtaggcgtactccttctttccgtcgcagtggatgaggttcctcttggcggcctccttcgcgatgatctcgtcaatcctgagagtggtcttgacgatctcgtcgtactcggcatcggtcagaccggccatcttcttcgcctcctcggtggtgaggttcatgtcggtggcctcgagcttggtggtggcctcgacgaagggctgagggagcttctcgccgtacttcacctcatgtcccttggggaacccgagctgctctgcggtgacctttcccgccttgaccctgtccatgagagatcccgcggcataatgcctgcagatgatctcgagagggatcagatagttcttggtggtgttgtcgatcttgctgtaatcccttatgatctgcacacggcggacatccatcctgtccttggagggctcggagatgtagtggttgttgatgccgttctggttgaggatgttgaaccagtacttcgcagtcctgcagagggtctctcccttgtggggaaccatggatgggatgatcttgtcgaaaacggagatgtggtcggtgtacgcgaactcgagggtatcgtcgtcgatggcgtagacctctttgaccttcccggtcattattttctgcatgctgcgctgattagttcccatataattatatttgactagggaacgcggacagttgtccgggaaggatgtgttcagagccttgcccgacggccgcataccctgcaggaatccctcctgcagacctcgtatatctccgtctccggacagcacatgtcgatggagagcatcctgcctgcgagaggggaacccgtacctgtcaataactgcaggacctgtacggcctccatggatgcgatattggtgaccatggcccctatggatggcgttacggtgcctgccggcgcatccttcacatcgccgtagaggcattcgagacacggcgtctccccggggacgacgaccgtgacctgtccggtataaccggaaacaccgccgtggacgagggtcttcccggacgatacagcgaacctgttgacgaccatcctggtacttatcctgtccaggcaatccactatgacatcgcagtcgccgaataccgccccgatgttgtcgtcgtcgagacgctcggtgaacgggatcgcacatacgtcgggatttacctccatcgcccattgtgccagaagctccgccttcctgtcatccgaatcttcgcggtagacgaactggcggttgaggttcgtgatctccgggacatccccgtccgctatgaccagggtgccgacgcccgcggatgcgaggttcgtgaccagggtggtccccagacctccgcatccggcgacccctaccttcgcatgtgccagcttctcctggccatccttccctatgagcgggatctgacgatcgtagcgggtgctcaatccctttcctccgcgaacctcgtgagcatcctgacggcctccaggacggtctgggtacggacatccccacggtcgcccttgaaaacaaaacgttcggatctggcacatatcccgtcggacacaccgatgtagaccagacccacaggcttggaaggggtcgcacctcctggaccggctatccctgtgaccgagacggccacatcggacccgtacagcctcacggagcctttggccatcagacgggcggtctgcccgctcacggccccgtactccatgatcactccgagcggcaccttcaatatggactccttggcctcgttggagtacgtgacggcgctgcctagaaaatactcggaggacccaggcatggatgttatgagggctccgatcagacctcccgtgcaggactcggcggcagaggccctgagccccttcctcttcagcacttcggccaatccctctgcggcctcgtcggcctccggacaatcgaatatcacaatatcgcctcagatcccgctgtcggtgacgtttatgtccttgacccttccgacgccgtcgatgtcgtccaccaccttggcgacggccttcgggaccagagacctccaatcctcgtcggccaccatcctcctgcggacctcggtgcctgagtatatgctcctgctgtacaggggggactcccttactgcgaaacccgcctctgtgaagagccttctggtgaatgggttgttgctgtatacgcaatcgaacgtgggacacatggccaccacgtgggacacccatatggagtatctgttgaggtcctccaccggcactatgctgtagttgcctatgccggcctccttcagggactcctcgatcatcatatagcgttcaccggccgtgaagggattctccggctgatgggaatactgggcgcttccgatgcctatggtgagatgctcggattcctcggcacatttgagtatgacctccatgtgcccgagatgaagcggctggaacctcccgatgaccaatgagtgcctgtcggttgtcatacgtaccttaatccgaatcggtcttataaaaataagtcaggagggtccaaggaccctccgatggtttggtcactccgatttcgtggtcggagcgggctcgggagcaggctccgccgcggggacctcctcgggaacgggctcggcaggtgccggcacgggctcctccgggggcttcctcccttcctcgtccagctgcttctccaaagcgagctcctcctcggagtagtcgtactccttggggggctcgagtttgaaggcggtggacttgccgtcggggttgaggggcaggagccgctccagaagcgcggtcttctcggggcagtcgacgaatgcatactctgcgacatcgcgataggtggtgacaccgtagacgtccatagttttgtagtacttgttgcgtatcatgacgtccttgacgttgtccgcagggaccaatgcgatcttgataccggaggatgccgccgcctccaacttggcggtgaccgctccgacgggcagtacgcggcccctgacgttcagacttccggtcatggcgaggtcctgacggatgggtatgttctccatcgcagacagtatgaccgtcgtcattgtgatggaggcggaatccccttcgacaccgtcgtatgtaccgatgtattcgagatgaacatccatctcggacatcttcttgtcggagaacttcttgatgaccgcggtgatgttgtccacggcttccttggcgatctccccgagcttaccggtggcgatgagctttcctccgtccttgacctgcgccggggtgacctcggcgactatggggagcatgataccggagtactcggccataccggtcccgggatcgagggccgcgagtccgttgacctgccccaccttggccccttcgatgttgaagagctggtatgctttgctcgactcgatctgcctgtcggccatctgctgctcgagactcctcgcattgaccatcgcggccaacacgtcgtcgcgggtgactatgcctgcggagcgggagacagcgaggtcgcctgccacacggatgagtcctcccagctccctgaacctcagggtgagccttcccttccttccggcacgcctctgggcctctttgatgacctctccgacggcgaacttgtcgaaatgggggatcttctcgtccttacggacctcctgggcgacgaacctcactatgtcggtcctgtgctggtccgtgtcgggcatggtggtgcgcatgtagatctcgtatccgtatcctcttatcctggacctgagggcggggtgcatacccttcatggcgtccaggttacctgcgcagacgaggacgaagtcgcagggaacgggctcggacttgacaagggccccggacgacctctcggactgtccggtgatggccatcttgtgctcctgcatggcggtgagcagggactgctgggattccatcctgagggtgttgatctcgtcgatgtagaggacacctttgttggccctgtggatgtctccggcctccaacctgttgtgggcgggcgtctcgagacctccggactggtacgggtcgtgtctcacatctcccagaagcgcaccggaatgcgtacctgtggcatccacgaacggcggcatgtcgttcgcatcgtgtcccacgagaagtttgggcacgtagctggaatcgttcctggtcatgaccgggttcctggcgaacaggaggatgatcatcaccgcgaagagcgatatgaacaggatgtaatagttggacaggaggatcgtaccgaggaacccgagtatcactatgcctgcgcacgcgtacatgtaggaagagttcttctgggtcttctgggcggccgcctgggccttctgctgggccaccacctgtttaccccttcccgcagggaagaccctgacacggggctcgttctcgtcctcggggttgctgtacgccacaatgtcctgcagctcctccttggggagatactccaccatggagtttgccagcatcgactttccggtaccgggctcgccgatcagcatcatatgcctcttctgggccgcggccttcttcatgacgtccactgccctgtcctggccgatgacgcggtcggacatcttctgcgggacttctacgtccttcgtggacttgaactcctgcttctcgatccattcctcgaccgttacgtcggagaggaccaggtcgttctcgtctttgttctccgtacctgcacctcctttttcctcttgagttagtttgtcctcgtataaaaagtttgaagattcgccgtctgccgccatcgtcactgctctcctttcttaccgatggagtagaggacgtatgccagcaaggcgcagatgagaccgatcacgatccacggggcgaactcggtcaacttgaccactatccctccgtcctcggcaggccagggatatccgctgtcctcgaggtcgtaagagacgaatccccccatgtacaggtcgtccgtgttgttgcttacgaacggctgatggctctggctgaaggtcaccccgttgttcacggtatacgctccgacgcagaggtaggcggtgctgtcctttccggtggcgtcgaacgtgacgtcgaccccgtagaccttggattccaggatgactatgttccatgcatgcaggtcgttggaagaactgccggccgcggtaccgaacacggtgaggcagggtatgccgagcttgtcgcagatggcctggaaggccgcggcgtacccggaacataccaggatgtgcttgccgtccgcaccggtgttcacgaaggccccgtagaccgttccgttgtagggacatttgtcgcccgaacccgaactgacggccggatcgtacttgaaatcgctgccgcagaggtaactgttgatcgccttgatcttgtcggccgtcgatgcagtcgaggagaagtcgaacccggagacggcggcgtctatggccgccgcggtatcggtcaccatccctttcagggccgttgcgccaccttcagcgtattgcttggtcatcatgatcttgaaggacaccgtcgaggacgagacatccacggaggggatggccgcggccggatcgtcgtagctccatgcccaccatgccatcggatccaccatcttcgtggccagccaggcgttgcgtacctccttcaggacgacgtctgaggaacccgcggaggacatggtgagggacacggtgatgtgataatacgtcgcacccccaacaacatccgactggatcggcgtgctgttgagatcgaggctctcgagcttgtcgtagacagccttctcatcggtgttcagctgattatagtaatagcctgagaatacggggtcggacgcggacgaatcgtcggagacgatcatcacgaacgacgccgccaggacaatcgccgccacggttgcggcaaataccgtgctgcgcgttttcatcggtccacacctatcggctctcattatttaaaccataagaaaaggaaagaggaaacatccaccgattggggccgaaacataccctcgaaacggttataacaagtcatgttctggggcatcgcatgaaattcagggacctcgacatccccgacgccctcagggacgctctggagatgcagggattcaacgagatgtatcctccgcaggcggaggccatccccaaggcgctctccggaaagaacctggtggccgccgtgcctacggcgagcgggaagtccctcgtgggtttcatcccggccctgaacatggtcctgaggaagaggtcgaaggtcctgtacatcgtaccgctgaaggccctggcctccgagaagagggacgaccttgcgaaattctccgatctgggtatacgcgtggtcatgaccaccggcgacccggacagggacgacgacgtgtcggatgcggacatcgtcatagccacgtcggagaaggcggactccatgatacgccacggcaacaggtggatagacgatctgggactcatcatagccgacgaggtgcacatgatacacgacccggggaggggacccaccctggaggtcgccatgaccaagttcatgcaccgcaacccggggatgcaggtgatagccctctccgccaccatatccaacgcggaggatctggccatgtggctggatgcggacctcgtgaggaccgactggagacccacgaaactcaaggagggcgtatactacaaccaggagatcgtcttctccgacgccagctccgtcgaggtccctcccgagacagacccgatctgggcgatgatcaaacagacggtctccgacggcggacaggtgatggtcttcgtcaactcgaggaggtccaccgaatcggtggcctccaagttctccaagaagatgctggcacttacggggtcgtccatcacggactccgaacgccagatgctggagggcggtgcggacaccacttccgtgggggtgaaactggcggactgcgtagcctgcgggatagcgttccaccacgccggtctggattacaagcagaggcgcgccgtggaggagggtttccgcgagaggaggatcaaatgcatcgtcgccactccgaccctcgccgcaggcatcaacctgcccgccagaagggtcatagtcagggacaccacccgcttcgagagcaatgccggcaacgtccccatccccgttatggagataaaacagatgtgcggacgcgcaggacgccccggatacgacccgtggggggaggcggtcctgatagccaagtcgtacgacgactacgagcatctcatggacgactatgtgtgccaggacaccgagaggctcacatccaaactggggaacgagaagaccctcagaagccacatactgggtcttatcgccacgggcgacgccgactcagaagaaggcatcgccgagttcatgcacgagacgttcttcggcgccacgtcccagctctacgggatagagagggtgatcgagaacgtcgtggacttcctcgccgaacagggcatggtggagaggaacggcgacagcataaggatcctcccgttcggaaagagggtctcggacctctatatcgacccgtggaccgccgtgatcctgaagaaggccgtcctgaagatggacgacgacacggacgagttcatggtcatgcaggtattggcctgcaccccggacgtcatggggatgtatcctaagaagtcggacaccgacatgttggagttggtggatgccgaatacgacgggaagtacctctgtaccctgatagacgaatgcggaggcgacggatacgaggaggcgtcgtgggacaaccacatggccgacctgaagaccgccgtcctgctcagggattggatagacgaggtctcagaggacgtcatcaccgacaggatgaagataggtcccggagacatccgctccagggtggactccgcggactggatactctactcgatgaacgagatagcgttcatcttcaaccccgatgcgagcaggaccatcaaacccctgctcacgagggtgaggtacggagtgaaggaggagctgatccccctggtctcgttcagaggggtcgggagatccagggccaggaccctcctcaacgccggcataaggaacaggaccgacatagccagatgggatgtgggggcccttgccgcactcaacaggatcggcccgtccctggccaagagcctgaaggaacaggcgggatacggggtgagggacgaggagcctccccgggaagattacgacgaagagaccgaatatatgttggagaagatggccgccgagatggacgagaaactcggcgggacccagaggaacatagattcgttctgacgctggaacactgaaaatgacctggtatgttatagacggcatggacgggtccgggaaatccaccatcgccgaccgtctgcgcaggatcctggagtccgaaggaaggaccgtttccgtattcacccatcccgaccggtcccggacgttcggaaggataagtgccagattccttctttccgacggagtcccggccgccgtcgccgccaccgtgttctacctattggatatcgtctcctccctcgcggcgatgagaagggtcggatcggacgacttcgtattcgtacgttacagtctggcggccgcctatctcccgacccgcctgtacaggatcggctacaggataattgacggtgcccttccttcccccgatatgaggatattcgtggatgtcggaccggatacggcgctcgagaggatcgacagaagaggggaggacagagagatgttcgagaccagggagaggctcgaaaagacgagggggcgcatgagggaactggccgaaggatggatggtcatagacaattccagtgacccggatcatgcggagaaacagctccgcaaggctctggaggcacatatgtcatgaacgaccctacatgcctctgcaagaccgagatgtccccggggaagaagaggttcgcagccgtcttctccaatctcgtacagccccctatcctggacatccccgtcctcctgctcataaacatggccgcggacggcggggcgggatatgcggtatccgcatccgtatccctcctgttcgccaccgttcttccgatagcggtggtcctgtacttctcgaagaagaccgggaacgatgacggggatatcgtgagacgcgaggataggatatttcctctggcggtcgccggcctcatctatctggcagggtccgtggtccttatcgcggcggatgcccccgacgttaccgtcgccatgatggtgagttgcctggtctgtacggcggccgtgatacccataaccatgcactggaagatcagccttcacgccatgggcataatgtgcgccgcagtcgcattgacttggacattcggtccggtcggactcctgtcgctgtccgtatatccggtggccatgtggtgcaggtacgtgctcgggaagcatacgcccatgcagatggccggaggaacggtcctgggtgcggtccttacgtcggcggtgttcttcctggtcgcatgaaccccgggatcggcgttgcctgatggcatcggttatgcggtcctcttcgtcgaccacggagacccagtgctccgcgatggagattatctcgtccatatccccgtgctccttgtatatcgctccgaggaccgcttccacggccgtcgcgatatgcttgtgacggcggtcctcgttcccgctcccaggagaccaattgtaatcgctggctatgttgcggtcgtcccgatcgtagaggaggtggtccattatgcggtagcgcttcccgatcacggtcaccagggtcttatccgattcgtaatgggacttggacacgctcatatgcccgggtctgtccagaagtatgctgcagagtgcgaacttcagcagcgcgtccccgtatgtggcgaggtcggaattcgtcatgctgttgtctggcacattacaattgacgaacttcttgtaggacctgtcggtgagggcgcgtttcatccagggaagatccctgccgttcgacagcatatctgagaaaacatcgtcggttctggatgcggacatgatggaccataccctcggataccgatgtctggaacatgttttccggaggggatatccccctccgggattatggtttcagttctcgctgaggatgcgctcgacatccttcacggagttctggcaggggatgggcttggggacgttggcgaggatcgtgtccgggtccttgagtccgttaccggtgcagatgcaggcgacggtctcgtccttgtcgatgacgccctgttccctgagcttcttgagtccggcgacggatgcggcggacgcgggctccacgcagacaccctccttccttccgaggaggagctgcgccttgatgatctcctcgtcggtgacggtggtggcgtatccctttgtgtcgtagatggccttgagggccttcttcccgctgacggggttgccgatcctgatggcggtggcgacggtctcggggttgccctcggggacgaagtccatcgcaccctcctcgaacgccttcgcgacgggggaggcacctgccgcctggataccggtgagcttcgggatcttgtcgatccatccgatctccttgagctccatgcatgccttgtagacggcccagatgttggccgcgttgccgacggggaggatgaccctgtcgggcatcttgaacccgagctggtcccagatctcgaagaggacggacttctgtccttcggggcggtaggggttgatggagttgagcaggtacagcttcttctcctcggacatcttcctggcgagtgcgagcgcatcgtcgaagttcccgtcgaccgacagaaccttcgctccgaagaacagggcctgggcgagctttcccatggccacttttccggaaggaaggaagaccgcgcatttcatgccggccttggatgcgtatgcggagagggcggcggaggtgttcccggtggatgcacatccgacgatcttggccccgagctccttggcgtgggagactccgatggtcattcctctgtccttgaaggacccggtggggttgagtccctcgaatttcacgtatgcgttggggacgcccacctcggcaccgagggcctcggtcttgtagaggggggttcctccttcctggatggacaccttgtgcgcagggtcgacgggcatgaagggggcatacctccagacaccgatctgcgtcttgcggaggtcctcggggttcatctcggagacctcggaaagatccatcttgacggtcaggagaccgccgcatttgggacagaggttgacgtaagggtcctttacctctgctccgcacatccaacatactaccttgtggtttgccatttcaaagcctcctgcatccggtgccgcaatcggtcacccagatatcgcatttcatattgttatcgttaaagactttcctcacgctctcggcgatgacctctcccttgtgggtgctcttgtcgtagaacgacatgacgcacggcccggatcctcccaggaaggagactatggcgccgtggttcatggcggccttctcggcctctttcagatgggggacgagaggtgcacgggcgggctcgaagaccatgtccgcgaccgacctccctatgaggggcagatcgtcggtcatcatcgcatagaccagggaggacgcatgccctacatggaagacgaggtccttcaccgggacctcgtggggaaggaccttcctcgcatcggcggtcgccacgagaacgtccggaagggctacgacgagtccgagatccttcggagggtcgatcttgaggacctcgaagggctcgtaggacctgatgatggtgaatcccccgaggatgcagggtgcgacgttgtcggcatggatggagccggaggtgtatccctcggcggcggcagcgcacatgatgacctcgtttatggagagcttctccccggtgaggacgtgtgcgaggtacgcacctccggccgcggatgcgccggatgacccgataccggaacaaggacggatgcccttggtgatcttgacctcgagaccgaagtcggcgccggccctcttgaggacctccgcagcggctatggtcacggagttcttggcggggtcgcgggtgatgctctccgctcccgggccctgtatgtccgagatgacgatacctgacggtatcttccttccctcgattatgtcgtagggttcgtgaattgcgagtccaaacgtgtcgaaaccggcccctatgttagaggtcgtggcgggggccgcgatcttgatccactcgtcgctcattgttatcgtccctcccgtaccgtgcctgttataataaacgtgcgcacgtctaataaacgttaacctccgacatggattccgcagggaaagcaacggttaactatgtgggaggcaatcgaacaggcatgacagacgtacaggtggtagggctccgcggggacttctccttcgaggatgcggtggagcatttcaccggcatgggcggggaggtggtccttttcgacccgtccgtcgtctgcgggaaggaccatatcgtcagcgcagtcatgcatgcggacagggctttcgccgaaggcaggaacagggcgaagaccctgatcaccgagatagtcctatacgccgcctgcgagaggcagataggcaaggccctgaagaagatgagaccgaagggggacgggacgatggtcgcagccgtcctaggaatagacggggatctggcactttcggatctgggtgcggatagggacgactccctctgcgatgcgtcggaggagaaggccaggaacctgggtgcggagatgttcgaagggatccccccggaagacgcggtcctggaacaggtcgccatggtggacctgatgaagcagtgaaccgtctgggtatttgttggatgattgtcggatgacacatccaaagtttaaatatgataattaactttccttaatccgaactaaccgtgcctggtagttccgtaccactccaccgccctcccgcagggggcggtacatttttccgcacagacttccgcaagaccgataaaccagtcgtgacatccggatgccggtgcgtcggaacatgaaggttttcgtctacaactatcgcagattcgacgaggagaagtacttccagcagtatgcggaggagttcggtttcgaactcggatacacggaggagagtccgaccatcgacaactgcggactggcggacggctgcgatttcatatcgatcatcacgacaccgatcaccccggagatgatggaccgcttcaaggagggaggggtccgcatgatatccacccgcaccatcgggtacgaccacatagacatcgcatatgcgaaacgtatcgggatgaccgtcacccacatcacatacgacccggaaggcgtcgccgaatataccgtcatgatgatgctcatggccatacgcaaggcgaagaacatcctggaacgcgggaaggataacgacttcaccctcgacggtctcatcggaggggagctcggggacatgtccgtaggcataatcgggaccggcaggataggaaggtcagtcctccgcgacctgtcgggattcggatgcaggctctactactgcaacaggagtcccagcgaagaggccgacagatatgccgaacgcgtggacatggacgagcttctgggtatgtgcgacgtggtgtctctgcacctggaactcaacaaggacacgttccacatcatggggcccgaagccatatccaagatgaagaagggagccctgatagtaaacaccgcccgtggaccgctcatcgacacggacgccctcgcggccggactggattccggacaggtcggaggtgcggcgctggatgtgatagaggacgagttcggcctatactactacgactgcagcggcagggaattggacaacaaggccctgaaggtcctgcgcggaagaccgaacgtgctgataacccagcacatggcgttctattacgagaacgccatccgcgacatggtctacaactcgctttacggcatgaagatgctggcggacggaaaggagataccctaccgcctcgcatgacccagatccgaaaaaccctttcgggaccccggccgaggccggggaaatgatttgtatcactcgggaacgaacttgtaaccatagtggatgacgccggcctcgccgtcctcgtcgagtttcctcagtacggccctaacgcgcataccgatctcgatcttggacaggtcgacgtccaccagctggccctcgagcatgaccccgtcgtcgttctttatcatcgcgacggcgtagggcatcatcctctcgttgaagccagagtactcgtggatcacggagaaggagtagacctcccccgacctcttgagcttgaacgggacgacctttccgatgctggcacgtctgcagtaggggcagaacgcacggctcgggaagaagatcttcccgcagttctcgcacttggtcccgacgaggttgtaccttcccgggatctccctccattccttagcggataccattgccatctcacatcgcctccaggatagaaacggttacagcagaacctgtacctccgacggactgtgccagaccgtacttggcgtccttgacctgcctctccccggccctgttggtgagctggagatagagctccgcgatctgggagacccctgcggctccgatcgggtatcccttggccttcagacctccggaggtgttgaccgcgatcttgcccgcatcgaacttggtgtccccgtcgaggaaggcctttccgccgttctcgtagagtcccaggtcgttgagggccatcactccgccgacggtgaagtcgtcgtggacctctgcgacgtctatgtccttggcctctatgccggcgagcctgtatgcgttctgggccgccacctgtgtggccttgaaggaggtgaaggactccctctggaacagtgccagggtgtcgctcgcctgtgcggtggaggcgactttgacgtaggagtcggtgtacttcttggcatcctcgaggggacagaggattacggcgctcgcaccgtcagatatgggggccccgtcgaacacggtcagggggtccgcggtatatccggagcggagcacgttgtccagctttatggccttctggaactgggcgtccttgttgaaggccccgtggaagtggctgttgacggcgcatgccgcgatctcctcgcgggtggctatgccttccttgatcatcctcctggcgatcatggcgtacagcgaggggagggtgacacccatcccggcctcccactccgcatcggaggtggcgttgaggatctggttgatggagtcgtcatcgaggtcggtcatcttctccgcccctccgacgatgacgacgtcgtgcataccggatgcgacggccatgacaccctgtctgaaggccactcctccggaggcccctccggcctcggtcctgatggccggcacgttgcgggtcgccataccggtgtagtctgagacgagcgcgtcgatatgctgctggttgatgaagcgggcggcgctcatgttgccgacatatactgcgtcgatctcgctccctccgaggttggcatcctccatggccttggccccggcctctatgccgagggccctgaaggatttcccccagagttctccgaacttggtgcttcctgctccgattatagctacatccctcatgttcactcctccggcatcttgatcgtgttcttgtacttcgcataggtcgcatagtccacatagacggggtcggcgaggatcttgtccagcacgggggcgttgtccctcctgtagctgtcgatctcgtcggtgaccgttatgtcgaaggcgtcgctcccggccccggaaccataggaggtcacgaggatcctgtcgcccgccttggcatggtcgaggacatgtgccagtccgagggggacggcaccgctgtatgtgttcccgatgttgggcgtcaggagtccgcactccagctgctcgggggtgaagccgagcatcttggcggccctggtggggaacttcccgttgggctggtggagtaccacgtagttgtagtcggccggggtggtgcccatggcctccatcatcatcttggcggcggacgtcacatgcctgaagtaggcgggctccccgctgaacctcccgccgtgcacgggatacatcataccctccctccagaagtcgggggtgtcggtggtgaaactgagggtcttgttgacctctgcgatgaccttctcggtaccgagcaggtaggcggcacctcccgccgcggcagagtactcgagggcgtccccgggggcgccctgagaggtgtcggccccgatggcgacggcatacttcaccatcccggccttgacgagaccgagaccggcctgtatgccggcggtacctgccttgcaggcgaactcgaggtctgcggcggtcatgttgggggtggcccctatggcctcggcgacgatggtcgacgagggcttgacggcgtacgggtggctctcggaccctatgtagacggccccgatgtcggcggggtccacgtcggggaccctgtcgagcatgtacctggcggcctcggtggagatcgtaacggtatcctcgtcgggagagggtacggacttctggttgatcatcagaccttttcccatggaagcgccgtcggtgccccatatccttccgatctcttccggctttatcctgtacctggggacgtatgccccgtaacttactattccaaccattttcacttcccttccttgagtgcgttcatcttgtcgatcagtttctccacggagagatccgtggttacgagggggatcccctccttctccgccagcttgatggccagcggatcggtttgatccggcttctggtacacgaccattgccggtgtgagcgggtgtgcacggatggcgaccatcggcgaacgtccgtaatggacgtccgtgaagatcaacgccctctcgacgctccatccgtatatcttcatgtaatcctgcgagctcagactgaggatcgccttgagggaatccacgatcgtatagccgtagatcctcttcttgggggtcttcatcggattgatgttcctccccgcgatcgtgcgtatgaaaagatcgtcgtctatcccctgagggaactcgtccatcgcgaggatgcattccatcttcttctcgggcatgtacttcgactgcaccggggatccgttcgcatcgtcgagtctgagaaaggcatcgaccatcttgcggatgacccctactccgggggacttgcgtctcccggattcgtaatcgcttatgacggagtgggatacgcccatggcatcagctagttcgtactgggatattccgaactcctcgcgccatttgcgtatggcccttcccggctcttcggagagggttatctctcctgcgattttctctcgcagttcgtcggacatcacgtccgctatcacgtgctcgttatataagggtgtcgtagtcctctatcgtcaatcgacgaatacattacaatatcacagaaacatcgtcatatatatcgggagatagaccaccttcccgtccacacgcaggtccttggagtgtatgacatatgccgtgtccgtacgcgtccctaacttctccatgaagacatccagggacttgtgcctgctggatgcggaggacttgacctctatcgggctgatcttcccgcttccggggatgaggaaatcgacctcatactgtgtagtgacgtctttgtgacggaaaaccgtgaatacgaggtcgtgtccgtgcgccttcagttcctgggcgaccacgttctcaaagaacataccccctccggccgagaacctccccttggttatcgagagatacatccctctcgcgacgtcggtatcgaaacccgaggcgagggtaaccagaagacccgtgtccagaaaatagcacttgggccgcgaccccctctctgcatcggccccgatacggtccgggtcgtcctcgcgtatgcacacgtttatcagacccgccgcctccaaccactccacggccctcctgtactgtctgttcctggatcccgactccaccttacagggggaaaacatcctgctgcgggaggatagattggagaggatcccgtcgaatacctgactcaccctgcggcctaggatgcctgagagcctaccgatgcaggcaccgtaagacctgagtatcatacgcttcaccttctccgcctccatgaaatcccctgtggaaaggaatctttccacggcttgcggcatccctccgaccgccatataatccgagaacctgtccatcatcacccggcagctgcctccacccaatgattcgcgcccgtcgaatatcgtcctcaggatgggtaccgataccgaatccccgcgagcccacaggaattcctcgaaatccatcggcagcatttcgaggaccgtctccccctgacacgtctgggtcttttccaatgtcatcccccgggacgtcttggaaaacacccctatgcaatccagatggcattcggaccgaatgctgtgcatcgcctatctagcacattggatttcctggatactgtccaatattacaaggccgtcgtaagggatcagtttcctccccgtcatggcctgcagacgcacgacgaaacccatgggatcggattggcagtccagaagcataccctccatggatctgctcttcttcgagaggtctatgcgtatataggacccatattcgttcttcccgaactcctcgaccgtcgaggtcttgcctactccgcctgcaccttcgattatgaggaccgatcttttctcctcttctttccacgagaccatgcggtcgtaaatctttctcttgaacatacgacgatatttcctttagttgaactgctgtgaattgccagttttaacgattccgtgagaggataaactgccagttttaacgattccgtgaaaggataaactgccagttttaacgattccgtgagaggataaactgccagttttaacgattccgtgagaggataaactgccagttttaacgaaccggaaggatcgtatcgacgaaccgtcagctctccagttcccttctcaggacccctacgagggtacgcatgaccgtaagctgcgcatacttcttgttgttggccgggacgaccacccacggagcgccaggggtattggtggacgagatcattgcatcgatgtattcctcgtagatgtcccacttctcacggttcctccaatcctcgtcggtcagcttccactgtttgagcggatcggccttcctgtcgttgaacctctgaagctgggtatccttgtctatgtccagccagaacttgattatgatcgcgccggagtctgagagcatggattcgaaggtgttgatctcggcggcggaacgctggtactcttctttcgtacagaagccttcgatgggttccaccatcatcctcccgtaccaggtcctgtcgaaaatggatatgtggcccggaccgggaagggaacggcagaatctccagagatatgtatgcgcatagtcctcgtccgtaggcttaccgaccctagccacgcgatatccgcggggattgagcgcgtgggagatgtgctttatgcacccgcccttgccggccgcatcccacccctcgaaaccgaggatcacggagcgcccgctcaccgccagaaggatctgcagtctctccagctcctcggaaagggcccccatctccttcttgaacccgtcagtggtacggtcgagttccaagccttccctcgggttttcgtagaccttgtctatgccgcatttcactgattccttccaggaatcgtccttgatgcactgcttgaaacgtttgagaaggaccttgaccgcatcgttgaccgtcttctcaacatggcctaccctgacggtgtcccagggggccctcttcgtatcggtcttggcgacgacgtcgtccatcagggagtagtacttgaagtggtctatgcggtctacagaaaggaatgtaccgttcatggcggtgtacggacgatactcgtccgcatactccttcatgatctcgggggtcacggcgagacggacctttatgatgaacgtgccgttgtccagaaggtactcctcgaatctgttcaggacatccagggccgcgtcgaggtcctccctgtcgccttcgaagcggttgatggccgtcgcataccacgaacggtcgtacatggagatctcccctttggcgggagtgcactgcagaagcctcgccatcgccttcggaccgttcttctccacatcgaaatgataatagtttatgccgcgaggctccaggaccctgtcgagctcgttgacgaccctgctgatgacgcgcccgctccccccctcgaatatcacaaggacggggatgcccttgttggcgatgtccatctggaccttgttcagttcttcttcgagttcgtccgatacgagggagcgcatgcgtgaaaatcctgggccttgttcttaatatttgctggaaagaggccgacggcatacgtacgtccccatatatggcacggtatcgtccctccggacgaccgatacaccatcggatcggggacatccatcctattaaatatggtatttaaaccgctttattaacggtcccgatggtaaagaatctttttcttatttccatattaataaaaaaataagctgatttatttaattaaaatattataagtaaataatataaatcataaatttaattatattctatggacgaatcggatttcataggtacaaagaccggggaagtgagatggtccatgtatggggaatactgttacttccacccgcacgacctcccttttgaccgcgattattcccccgaggtcatatctgccatgaccgatgcgtcgatagaactcgcacgtctggacggtatgctcggactcgtcgacgatagtacggtagagatgctcagcaggaatctgtcgctcatggaatctacatcgagttcgtccatagaaggcaccagatccactgtggacgacgtcttccgttcggaaaaagaagaagagaagaacgaatcgataatcagagataatcaggagatcaccaattaccgcaaggctctgattcagggtttcgatgaattgcccgcaggaggcagattcgagatagagatcatcaaaagactgcaccggacacttatggcaggggtcagaggttcggacgaatcgccgggagagttcaaggtacatcagaacgccatcgggatggcgtcggatacactcgaaacagccaaaatggtccccgcatccccggagagcgtcgaccacctcatcgacaactggctggaatatgtcaactccgattcactgaatacggtagaaaaaatggcgatggcacactatcaattcgaggcgatacatcccttcagagacggaaacggacgtgtagggagactcctatcgctgatgatcctccgccgcgacggtcttttgaagtatccgatcctctacatcagcggctatctgaactccagaaggagtgaatacatggacctcatgtacagagtgagcagcagggattccatcgacgagtggctgacgttcttttccgaaggtctgtgcatccaggcaagatccgcagcgaagaccgtggaggccttgataaggtacaggaagagactgaccgatgcggcagaggatctgaaagagacgaaggtcgtggagatgctgttcaggaacccatacatcacctccaggaacatagtcgaagaactggacatctccgtccctacggccaacaagatactcgacagattccagtccgaaggaatcctccgggaagtgaccgggaagaggcgcaaccgcctttactgtgcagaggggataatagacatcctcagatgacccgggcacacgcatgcacggcatccgggataacaaggaaaggacgtccgccgtcccgccgaaatgcgttaaccccgggaagcggaaagaccgtctgcacattgttttaataccccatccctatcgtacgcgtatagagattgatcccatgaatggaatcggagactgcaccaagaagataatgaccgccgagggggaggtcaccatcttcagccttagggaactggagaacaagggcgtagtgaaggacctcaagaaggtcccttactcgatcaggatcctgatcgaaggcgtcctcaggcagaggggagagaccatcggagacgaggacgtgaggaacgtcgcctcgtggtcgcccaaaggtaacgacgtggatatcccgtggatccccgcaagggtcctccttcaggaccttaccggaggggccgccgtcaccgacctcgcctccatgagggaagccgtcgccaaaatcggcagggatccggagaccatcaaccccatcatccccgtgaacctcgtcatcgaccactccatacagacggacgtggcaggatgcgcggacgccatggagaggaacgaggacatcgatttctccaggaacaaggagaggtacgccctcttcaaatgggcccagcagtccttcaagaacttcacggcggtaccgccgtggaacgggatctgccatcaggtcaacatagagttcctgtcccctcttgtacatgtgaaggaatgcgacggcaggaccatcgcctaccccgactcctgcttcggtaccgactctcacaccacccagatcgacggcctcggcgtcgccggatggggagtgggagggatcgaggcggaggccgtcatggtcggacagcccagctacatgaagcttcccgacgtcgtcggattcaagctcaccggcgagctcagtcccggcgtgaccgccaccgacctcgtcctcaccgttgtacagatgctgaggaagaaaggcgtcgtcggcaaattcgtcgagttctacggacccggataccagagcctggacgtctccgacaggtccaccatagccaacatggcgcccgagtacggcgccaccatgggattctgccccgtcgaccagaagaccatcgactacctcagactcaccaacaggagccccgagcacatcgagaccatcaagacctatgagatggaacagatgctgtggtacgaccccctcaacatcccggaatactcggactacctcgaactcgacctcggcgacgtagaacccagcgtcgcaggttacaagaggcctcaggacaggatccccctgaaggacatgaagaccgccttcggcgaggccctcaaggccctcggcgtccctgagcagaggatgggcgacggggagaggatgggcgacggatcggtcgccatagcctcgatcacctcatgcaccaacaccgccaacccctccgtcatgatcgcggcgggactggtggcgaagaaggcgttcgagctcggcgtgaaacccaagaaatacgtcaagacctccctcgcccccggatccaaggcagtcacggactatctcgtgaagtccggtctgcagcagtatctcgacgcagaaggattccagaactgcggatacgggtgcatgacctgcatagggaactccggacccctctccgacgacgtctcaaaacagatcaccgagggagacctcgcggtcgcggcggtcgccagcagcaacaggaacttcgaagggaggatccaccccctggtcaagaccaactacctcatgtcccctcccctggtcgtgtgcttcgccatcgccggaagggtcgacatcgacatgacctccgagcccttggcatccgtcgacgggaaggacgtctatctgaaggacatctggccttccgacgaggaggtcaaggccgtcatggaccagtacgtaaccaaggaggcgttcgccgccggatacgacaacatctacaagggatccgacaaatggaactccatagagtgctccgagacggccctgttcggctgggacaaggactccacctacatcaggaaccctccgtacttcgagcatctggccgacgagcccgagataaaggacatcgaaggcggcagatgcctcgccaaactgggcgactccatcaccaccgaccacatctcccccgccggggcgttcggggagaaatcatccgccggccagtacctgatctccctgggtgtgcagaagaaggacttcaactcctacgggtccagaagggccaaccacgagataatggtcagggggaccttcgccaacgtgaggctcaggaaccagctcgtccccgggaccgagggaggatattccaaatacgtaccggacggaagcgtcgactacatgtacgagacctccgagaagtacaggaaggacggttctcccctgatcgtcctggccggaaaggactacggtatggggtcttccagggactgggccgccaaaggacctctcctgctgggggtcaaggccgtcatcgccgagagcttcgagaggatccacaggtccaacctggtggggatgggtatcgtccccctgcagttcagggacggcgagaacgccgacgagctcgaactcgacggtaccgagaccttcgacatcgacctctccgacctgagccccaagaagatcgtgtccgtcctcgccaccaaacaggacggcaccatgatcaagttcgacaccatctgcagagccgatgtgccggtcgagatcgaatacatcgccaacggcggtatcctgccgttcgtcctgagaaggatgatcgcggagtgaggtccggacccctcccttccgggagggtccgacccacaaacatgttcgtatcatcatttttaatcatgccaaccgatttacaaatgtctgaatatggatccatccgagtgccttgaaaagggtcttgcggcctacaggaggggcaatttcaagaaggccttcgccatgctttcggcggagaccctcatggacgatccgaccgcacagtatctcctcggccggatgtactatgacgggaaggggacgagacagtcctacgaactcgcgatacatctctacaagggtgccgcctccaaggactgtgccgccgccatgaagagcctcggatggatgtatgaattcggaaagggggtcccgcagtcttatgaagatgcggtccgctggtacaggaggggggccatcctcggtgacgcctcctgccaaggttatctgggcgacatgtaccagtacgggaagggcgtgagacagtcgtactacatggccatcatatggtattccctgtcggccgaacagcacaacgactacggtctgaagaaactgggtttcatgtaccgcgacggaaaaggtgtggaacagtcgtacgaacgtgcggccgacctcttcatgatgtccgccgaacaaggcaataccgacgccatgaggggactcggctggatgttcgagaccgggaagggggtggcccaatcctatgaggaagccgtccgctggtacaggaggggggccatcctgggcaacgccacctgccaatgcaatctgggttacatgtatcaatacgggaagggcgtcccccagtcggacaaagcggccgtcggatggtacaggaagtcctccgacctcggcaacgagaacgggatgatgagactgggatacatgtaccgtttcggaaggggggtcccgcaatcctacaggaaggccctggaactcttcgaggcggcggcggagaagaacaaccccgacgccatgaggaacatcggatggatgtacgagtccgggaagggagtggaagtatcctacgagacagcggccggatggtacaggagaggggcggagctgggagacgcctcgtgcatggacagtctgggactcctctacctccacggcaagggcgttccccagtcggacaagatggctgtggaatggttcaccaggtccgcgaagaacgggaaccagtacggccagagggatctgggtcatatgtacgagtccgggaagggcgtgataagggacctgaaggaggcggtgcattggtaccagatgtccgctaaccagggaaacgtgaccgccaagagcagactcggcgccatgagacgtgcggaccagccctgaacactgtcccgtcagctgcatttatatggatttgtacatccggtcgttccctgcctatgtgattgcaagggatgtgaatgcggtgatcacatgcggtattgacctcggggaccctgtaacaacccggcattcttccccaatatctcatccaggagggacctgcatcccagacatacatcgcgatacgtctcggtgaaatcccccgtataccaggggtcgctgacttcacgcgcggatcccgcatgctccatcaacaacgacaccttgcggtcggggtcgtccccgacgaaacatcccatgttcctgatgttctgacgatccatggccactatgtagtcgtaatgacggtaatcgtcgcacgtcatacgtctggcacatctcctgtcgtatatcacgccgtgcatgtcgaggaccttcttggtccctttatggatgtcgttgcccaactcctccgagctcgtggcgcacgatgctatctcgaaggcgtcctccagacccctctgtctgaccatgtccttcattacgaactcggccatcggactgcggcagatgttgccgtgacatacgaacaggatgcggacgaccatgtccggtccatgtgccagcaacaataaaaagactgtcaccgaccatggagcggaacaacgcaaatgacttgaatacctacccctataagagaccgtaatgaccgctgacgaggagctctccaaaggatgcagattcatcgaagagggaaagttcgacgaggccaggaagatcttcctgaagatggcccgcaagagcatacccgaggcccagttcaatctcgccctcatgtaccaggacgggaaaggggtcccccgttccatgaagaaggcggccaaatggtataccaaagcggcggacaatggcatggacgaggcccttctgaaccttggatgcatgtatctgctgggaaacggggtgccgacatccgagaagaaggcattcgacctcgtccagaaggccgcggacaacgggtacggaaaagcccagatccaactcggcgtcatgtatgagttcgggtccgggaccgtacagtcatatgagaaggcattcggctggtacaatgcagcggcccagcaggacatacccgaggcacacgtagccctggccaggctgtacgcctccggaaacggtgtcagaaagtccgagaccaagaccatatcgttgctggaaagggccagcaacatgggttacggagaggcacaggagatcctcggaaccctctactactacggggagggggtcccccgctccccggccaaggccgcggagctcttccgtctggcggccgaacagaactacccatccgccgcattcaacctagggatcatgtattccgaaggagacggggtggaacaatccgacgagcaggcgttcgtctggtacaccgcggcctccaatatgggacattccgatgcccaattcaacctcggagtcgcatatgatttcgggatcggatgcaaaaaggacctgatggaggcggccaagtggtactccatgtccgcatcccaagggaactccgatgccctctgcaacctcggcgatatgtatgagaacgggagaggtgtagagaaggacttcgacaaggccatgaccttgtataaggcatcggcggatctgggaaacgatctggcacaatgcagtatcggagacatgtaccgcaaaggggaaggagtaccgcagtccgaccaggaggcggagaaatggtaccgcacctctgccgagaaaggatgcaaagaagccataaacgaactcgtgaaaatggggaaggacgtttccggatacaatgcggaagactgaaccttgcatcagaaaggtaatcagaggtccatctcttcgaacagaaccttcgccttcttgttctggaaacacaccccgtagaggtacgtcttccccttcatcccgagatagtactccttggtcttgatctgcgtcagggccttcctcgcctccttctccatggtgttgaagatgtccgtcttggacctgctcttcttgagttcgacgacgatgttcggatatctcggatcgttgcggcgcattataatgtcggccctgccgttgccggcctccctctcgatgcccacgtcgtatctgcctcccctccccagggcgatggtcgccagaacaagccggtagtcggcctcgtccttcagcaggatgtcggggaagttcttcgagaacagcatgaacaggctctcctccatcttcgggacgtccgcattctccatggagtcgaagagaggcttgaacaggtctttgtcgaacctccacaccgaatcgatcaccttgtcgtagaacaccttgtacatctcgcggttggggatggacaggcggtaatcgttgtcccccttggggacggcgttgaggtacccggccacggccatgatcgagtatgtggcggtcggttttttccctacgtcctccattgcaacggtagggtttatccctttgacgaccgcctgtccgttgccgagggccaccaacaccgagttggtatctttgtcggcattctccagcaacacgtccaggatgtcgttcccgctggtgtcggcccagtaggtgccgggctcgaaatcgttgtatatgtaggtgagcaggctccaaggattgtatatgtcggcgttcccgaacctgtatccgttgtaccactccttggcctcctcgaacttctccggatgaccgtaatatgaacataggtccttgacctccggttcggtgaacccgtacctctcgtcgaatttcttggagaagacgttgtcgaccctgagattgttgagaccggagaatatgctctccttggctatctgcatcacacccgttacgacggcgaagctcatgtgcgggttacttttgagtacaagcgagtagaactcgcgaatgaaacctacgacatagtcataggtgtccttgttgaacgcgttgttgatgggattgtcgtactcgtcgatgaggactatcggtttcaccccgtggtgctgttccagcatctggcacaatgcaggtatggaatccagggccctcgcatcctcgaaatacaccggatccttcccgagatacaggtcgcggagggattcggacaccttgtccgacgtcttgaggtattcgaacggacggaacgtcctggacagcatccctttgaacatcgggaggaacatgtcacgcctgctcacgaacaggtccttcatattgaggataatcacaggatatgcattcctgtgcttctccacctccggatgggagttgaccttcagcccgtcgaaccacttattgcccttgtactccagattgaagaaggcgtcgatcatggagaggttgagggacttcccgaaacgtctgggtcttgtgaagaggaagaccttggacttgtcgttgacgatatccgagaccagttcggacttgtctacgaaataatatcccccttcgcggatctccctgaaatcgtccacaccgctggggatcgccaacaacctgccttcccccttcatgaatgcatatatcatttcatgagttataaacatgattcctgtggagcgaatgtactgtccccttcatgggcccccatgttctcagcacaatgtgccagactgccgtatgtactaccggcccatacgtgatcccgacacccaatcaataaatccgataaaacgaatcggtgtgtccatatgaatgcgaaggaaatggagaagcttaccgaccacttcgagaggtgcttcggtcagaaggccgccacggtcatgcgcaacaaggcagagaccgagctgcccatagacatcctagtgttcgcacctacgggaaggtatccgttctggaagctctgcaccagaggtgcgagcgactacaggatgcccaagagggagggcgtaagatacggggagaccgccaccctgcaaaacgagtacatgatgttcctcgaccccactgtgaggatcgaggaggggtccgacgactggctatggtattggcagatattgaccgagaccgccatgttccctttctccaacaggatgggcgtcatagccacggacatcatcgatctgggcagggagcaggacaccatgcaaggcgtcatactgctattccccgaggtcatagaggatacgtccatcctccagtgcaggatgggtctcggcaggaacgtcacctgccttcaggtcatgcccgtgaccaagagggagctcgagaggcgcatcgacggcaccgatgccgacgacgactggctctacagccagttctaccatcatgaccccatgaggcccgacaggttcatagcgcagagggagagggactgatatggcggaacgtgtactgaaagtcacttcggaagacccgcggttcgtcccggacgccatgaggctgggggatgcgatggacttcctggcggattcgacggggacgaacgatgtgtgtaccgagtagtggtgctctccgaagttcatagactgcggagaatacctggaaagcatcgtgtgcccgttctgcgggaaggaggtccccttcgattcatggggcgaggccatgaacgtggcggaggggaagggtttctcggacctcggcatgacgatgccctgctgcggcaggaaagggtcgctggaccgtctggattacaggaggccgtgtgccatagccatgttcaagatagagctgaggaacgtccccggggatgtcaccgaggacatgctgaaggaggcagggaggatcctcgggaccggtctgaagaccgtcgaggcgaggtactgaggagggacggccgtgagaacgtcattcggaaagacttcggaaggggcggaggtggagatggtcttcctggagaagggggacctgagctgcgggatcctcacctacggaggtgtcctccagaacctctacgtcccggattcgtccgggttcgacgtggatgtcgtcctcggttacgagaacgtcatcgactacgagacccgctccggccgcatgggggccatcatagggaggttcgccaacaggatagccgaggggaggttcgaactggacggaaagacctacgaactctcccggaacagaggcccggaccatatccacggagggaacaagggattcgataagaggatctggaacatagaagggtcgtcggaaagctccgtcaccctgtccctccagagcgccgacggggaggaggggtatccgggcaacatggatgtcagggtgaaatacaccctgggcgactcgggcctgaccatggactatctggcacattccgacagggataccgtctgcaacctcaccaaccactcatacttcaacctgaacgggcacgggaacggtacggtggaggaccaccacgtcatgatcaactccgaccgtcacacggtgttcggagggaggtccctgcccacgggggagatcgcatccgtcgaagggactcccctggacctcagggagccgagggccatcgggaccaggatgagaaggtacggcgggttcgacaacaactacctgttggacgacatcatggcggccaaggtgaagggacccaagaccggcatcgagatggacgtggtcacggactgtcccgccatacagttctacacggccaacggacttaaggagatggaaggaaaggacggcgcgagatacgggaaatggagcggactgtgtctggagacacaatactgtcccgattcccccaaccacccggaattcccgtcggcggtcctcagaaaaggtgacgaataccgtcaccgtacgtcctacatattcaacttggaatgagagggtacgtggtatcagaaggataccgacctccaataacggtccgccagtcccggatccttctccgtcctgtatccttcgcggtagaccgcatccaatatcaccgaggcctcggagacgcctttctccgagagggatacgagcttctccagagcgggtgccgcatcccctcccctcagaccggctatggcatccaagagggtgtccgcatcctccccggcgtcagctgcggatacctccgcctccatgagggacatggcctcctcggccgtatcgggacggaatccgtccgctatcagaagtgccagatggagttttgcatcggggtgtcccttctcgtcggccttacggaagaacttgacggccgacctgacctccgtgaacggacatccctcgtactccccgcccatgagcatgccgaggcggaaaagagcctcgggatgtcccctcacggcggccacgaacagcgtccaataggccttcttgaacgatacgaggtcgtcggcggcatcgaggtatctcatccccgcacggaagaacatgtctatatccacgggagggacgtcgtcgcccgaatatccgaacggatggttctgcttgaatatggaatacgccttctcggcatccttcttcttgacaccgttgtcttggagtatccctacgaccacatcctgtctctcgagtatgaacatgcttccggtacaatatgtggcgaggatctcttcggccttcatggcaggtggaatgacaggcgggggattatatgttttcccggagtattccgtgccatcgcatggacccgatttcagacaaagctgtacccgacatggccgacatttgttcctgtacggcttttgtgaagatgagatatcgattttttcgaatatcaagcacaattatatatcatatacttgctatatttgattaaacttctcgaaaaaatcgaatgagctggaaaaatgctgataaaattcagagttgagaactacaaatcgttcgacaaggaacaatccctgtccatggtatccggaagtactcgcgaccacgcagaccatgtgtatgatatgaaagaccaggggatcctccgcacagcggtcatattcggttccaatggttcggggaagaccaacctcgtcaaagcgatgatcgcttcgagaggcctcatattcggatacccgatcccaaagaacgattactgcaggatcgatccggagaactccaaaagggccactgcattcgagtacaccgtggaactgaacgggacacagtatgcctatggtttcgaagtactgctgtcgtccggagagatattgaccgaatggctgtacaatctgtcgaacagaggcaggcatagcaagatattcttcaggaccaaagacgccatcgaaacagaactggatctacaagacgaggattcgaaatatttcgaagtatactccatggaggccagatctgccggatggattccgttcatcacggtcatgtcgaaagctcccgagagggagggaagtaaactatcggccataaacagattgatgagatggttcaccaactccctcaggatagtcgcagcaggaacatccctcaactacaacataaacagcaacctgtccgatttcacagggaacacccttccgcattatgggacgggaatatccggaataagatacgaggatgtaaaggaccgcagcaacatgatacctcccgatctcctggaacagatgatgcgggacatcgggaaccgtagcgaacccatagggaccataagatctccttccgggatattcactttgaccgtcggaaaatcgggagagcccatacttaaaaagatgatgttcgaccacaacggaacatcgttcgaatacaccgaggaatcggatgggacgaaaagactggcggagctgcttcccctgctgaatgggaacgatctgaaggatctgacatatgtcgtggacgagatcgacaggagcctgcaccctcagatgacccagaaattcataagggatttcgaatcgctcccgaaagatctcagaagacagctgatcgtaaccacccacgaatccaggctcatggatctggatattgtacgcagggacgagatctggttcgtagagaaagatacggccgggacatcgaaaatctattccctggaagcattcggagagagaaaggacagacgcatcgataaggcatacttggatggaagatacggtgcgataccgtgtttcagaagcacatttcccgatttggagttatgatgaggcccacaactgcaatatatgtcagaactaacggggatccccccaccacggtgaaaaatcatctgaaaaagatgatggattctggcatcattggaagaattggcagcactgaatcaggtaaatggattattgtcaacctaaagtgacatgttgtttcttagtccatttcttagtccatatgggatttaatcatacgatcaccattggaggacctcgtcatcaatcttgaactatggatgggattccgttctgtggaagtgttcaggataagggtatgcgatatccattacgatcccgagatcgtcacgcagcatatactgagacgttcctacagaataaggctatatcatgccggtgtgaagatcgagaagatctcagagctcctcagacataatgattcccacaccacatacaagtatctcgggatcaacatcgatgacatgaacgatgccatgaaaatcctgagggacttcgacaagaggtcgtctctcgtaatcttttggttacatcctaagggttcgacaaacgccttacaatcggtgtaaaaaccactctttttcagttagtcaatagtgccagaatgaaaatccaaattccaagatacgggatttcgtccttcccacttccacagggatgtccctaggagagaggacgtacggtatcccttcctccttgcactttccgggcggaagtccatacccgtaggcggcggctatgaatcccgctcccgcctgtctcgcaccctccaggtcctgaggacagtcgcctatcatgacgacgatgtccgcatctgcctctctggcacatctgcggaccatgtccgccttggtcacgggactggatcgctccgcagtcagcgtgaccaagtccgccagatacaacacggaggccgtggacaaggggaggtgcagagtcgtatggggcgacgtgtcctccatgccgttcgaccgcggttcgttcgatctggtcacggccttcgagaccgtgtatttctggccggacatcgtcggttcatacagagaggtcctgggatcactgagggagggcggcagattcatgatatgcaacgagaccgacggcagcggtccgcacgacgatgtgtggacgaggagaataagcggaatgaggatctacagcggggaaaggatggaaagcgacctgcgggaggccgtattccggagcgtaaacgtatacagaaaggacggacgcagatggatctgcgtcatagcccacagacgagaccggtccgaaacttcgggaaagatgtgaagcaagacggcccgggcaggacatgtgacccgggccgtcggaaatcgtccgtatggggattcagacgactttggtcacatggatgctgacccctatgtcgtccgtcgcttcgaatccgacccgggggaaaccgttgtacacttcgctgatgacggatccttccgtgcatcccgtgatcccgatcttcaggatgaccgtcgtctcacctatgtatccagtgaacgtggacccctcttcatcatagatccatcctgtcccgaactcggccacgatgatggcgggggaatagaattggctcgctaggccgaggcttctgccgttgatcgtgaatgagactttgtccttatctataccggatgtggaacaactgtatgacgacacgctcaaaggcgattccgcccatttggcatacagggtcattccttcggacacggggtctccgaccttgtaatctataccgctcccgtccctggcggtgttccagcagacgaatatatgaccgctgtaggagaacatgttgatgacggcctcggcattcgaatacttgaccgaggtctccccatcagacgtcttaccgccgttcccatcataagtaacgcctttctccacagggtccatgaggcccgggactgcgacgatggcggctccgaccgccgccactgcgactacggccacgattgcgatcgacacattcttggataatgtcataacatgtcaggagacgtacacctaaatacattcgtccgacagacgacatgagggatcggaccagagacctgccaaccggaggtctaaagaatacagaaattctgagttgtaccattttaatatcaggaccctctacttgacgatgatccgtaatgacagacagcgacagcagcatcgttccggtcaaaaggaggaacggtctcaggaaggatctccgcgagatctacgaatcgaggaacatcctcaggtccctggtatccaagaacctgttcggacgctacaggaactccgtcctgggattcggctggcacttcgtcatgcccatcgtcatgctggtcgtctactatgtggtcttcaccgaggtgagggcctcccccatatcggacttctgggtatacatcgccgcaggaatattcccgttcaacttcatggtgtccaatctgaccggaggggccggggccatagtcggtaattccggcatggtgaagaagatgtacttccctcgggagatcctcgtcctggcacatgtcataagcaacttcatcgtgatggttatgggctatgcggtcatactgatcataatcgcggtgacgggatatcccctggattgggtcccgctgctgttgcttccggccatactgctgctgatggccctgttcaccaccggatacatccttctgttctcgtcgcttaccgtatatgcccgcgacgtacagtatatattgagttccgtcagcatggtgttcttcttcatgacccccatgtatttccttgcggacagcgtatcgggggtgttggggaacgtcatctggctgaacccgttcacatattacatagaagcattccacagcatggtatacttcggggagatccccgaaatgaaggtcctgctgatgtgcatcatactgccgttggtctcaatgatgttgggactggcggtattccgcaggctcaaacgcggattcgccgaaaggttgtgagatagatggaccccaagaacgccatagagatcaggaacatcgtgaagacattcaagatcgaggtggaggaccccgagaagaaagggggcattctcaacaggaaccctaccaagaccatcgagaacaaggtcttggacgggatcacgctggatatcagaaaaggcgatgttctgggagtccttggaaggaacggaagcgggaagagcaccttcctttccatgatcgccaggataatggagccggattccgggacgatagagtgttccgggaaggtcgcatcgatccttgaactcgggatgggtttccatcaggatatgtctgggagggagaacatatacctcaaaggggagctgtatggattcagccgcaaggagatggattccaagatcgacaggataattgagtactctgggatatccaagtacatagacaacccagtcaggacttattcctccggaatgtcgggaagactggcgttctcgatcatgatgaatgtggaatccgacataatgctggtggacgagatcctcagtgtcggtgacgccgcattcatggccaaagcgaaggaacatttcaagaaacttgccaggagcgggaagaccgtggtcttcgtctcccattccataaacgacatggccgacatgtgcaaccgtgccgtatggatagaggatggaaagatcataagggatgggagggcaaaggacatctgtgcggaataccagaataagatgtcgtcgtctccggagatcatagcggatctggcggaggcgggggtagcggaatcgcagtacgaattggcgatgatgtaccgggacggtacgaatttcggaaaaagcgaggaactgtataaggaatggatgaagaaggcggccgatcagggacacactttggcacaggtcgaatatgcagacatcttgttagagagaggaaatgaagatgacatttccgaagccatgaatctgtaccaatcggctgcaaacaagggaaataatgatgcccggatgaaaatcgcatcattcaggaaaaatacagatgatgacgacctgcgcacggagattaagaagatcttccttaaaatggccgaagaaggggatccgatcaaccaattcagatgtgcagactatcttctgaagactgcatggactaatgaagataggaaggaagcatttgagtggttcttgaaatcgtccgagaagggataccccaatgcgacgcaccaggtggcgctgatgcagagggatggggtcggtatagctaaaaattatgaagagatggaaaagaacctgaaaaaagcgagcgattctggattcctaccttcgatcatcctgttggcagacacatacattcaaggaaggcttattccgaaaaatgaaaaaggtgcttttgagcaatacctcaaaggagcaaggctcggaaatggaaagtgccaatatcagattgcaataatgtatagagatggtatcggaaccgagattgatgtcggtgaatccgaaaaatggtttgaaagattctcgtattccacaacaatctggaataacatatgggccgcagactgggctaagatgcaagacgattccgatcccgcattgattgagaagatatatctcagaagtgcatatggtgggaatacaatagctttgtcaaatatcctgaatactgcaattgccaataatgaattcgatgagaaaaaatatgataatctgatgaattcattgaaattcttagcagaaaatggaaacatagatgctgcaagaagaatgggcaatcactattatgatggtgttggagtaaaaaaagactacaccacagctataaaatggtatgaaaaagcagcacttctcggcgatcaatggagtagaaatcgcttaggagaaatgtatagggatggtaagggaacatcgcctgatgtagaaaaagcaatggaatggtttgtgaaaacatcaatttttggaaatactacatcaataaccaatatactcaacttatattcaactggaactttagaaaaaaacatattttatgaaaaaagtatgaaatttttagaaagattagcaacaaacggaaatattgatgctgcaaaaagaatgggcaatcactattatgatggtgttggagtaaaaaaagactacaccacagctataaaatggtatgaaaaagcagcacttctcggcgatcaatggagtagaaatcgcttaggagaaatgtatagggatggtaagggaacatcgcctgatgtagaaaaagcaataacgtggctaattgggtccaagtctttaaatacagtcgaataagatggaaaggggggtgatttcttccccatttgattacgtaacaaagtcatgtttaaattgcatcattcattaactggactagaggattatgaattatcttgaaatgacaccctccagtttgagagtaaaaatcaaaagtatgtggcacagttcaggtgcaacatcggaattactcaatatctttaaaacaataagttcaataaattcgtattggaaacaaatgaaaaacgatgtgtggcttatttacttatgttgcctaattgaaaaaaacgaaatcgacgaatttaataaaatcttaattaaatataataagatgtacaatatgaaagatgtagagcgttttctgccactttcacactatttgtcacaatctacagatttattgaaaaatataaaagtcccgtatttttttaatgatactctaaaaaaatctaatgatgtttatgaaaaattaaaaaataatgagaacctgtttactgatttggtaaaagacaagtcgattgccattgtaggcaactctggttgcgaaataggcctaggcagaggcaatgaaatagatagtcatgacatagttattagatttaataattattgcatcgacggatatgaacaagattatggtactaaaacagatatttgggttcgtggttctgctggagaagacatcattctacgtgatccttccaactataaactaatagtatgggaagcagattacgaccatttcatggttcattttgataatctagacacactatcaaaagatttgtctaattttccaaataaaatatcaaatttcaatgaagaaacacatgttaaattaagacaattaagtggattaaaatttccatcaactggagcattgaccgtttgggcaacatacttagccaagagtaatttaaataatgtcgatgtttatgggttttcttttattggaaataattattcggatacgaatcactattatggtgaagaatctagattggctcaagatcacgattttgaaaatgaaattaaattcatgcacaatttttattttgaccacaaaagaaatggcaaagaattaaaaaaatcagacgtatagattttcatttcttgtcataaagatacagaatatgttaaaaacgatatatttaaaccaatacaagttggaacagcgctatctggtaagaaattagacatgctacacgatgatgagggggaaaacatctcatttaaaaacaaatcatattgtgaacttaccgcacagtattgggcttggaaaaattgctccgtaaattactatggatttctacattacagcagatattttaatttcacagaaacaatatttcctgaaatcggctacaataacataaatgtatcaaacattactgatgaattaattgataaatttggttggactgaaaaacaaataattgagtgtattagcggatacgacgtagtaacgacattttcagccaatacgcaaattgtacaaaagaaaaaagatgtttatgaaaattattgcgatgccgcatacctacatgaaaaggatttgttaacacttactcaaataatcgaagaaaaatatcctaaattttcgaaatatgtagaacaatatttgctaggacaaagagcaattttttgcaatatgtatatcctacgtaaggacatctttaatgattactgcacttggctttttgatattcttgatgaatttgtaaaacggaccgatatgtctctctacactgtaaatgaaatgcgtacgccaggacatctgtcagaaagaatgtttgggatatatctattgtatttgcagaacgaaagaaaggatattaaaattaaacaactacaaaaagtatgtttcactaaacctcgcccatcgttgttaatgcaacagccagaaaatcatgtccccgtggtattttcatgcaatgagcggtatttaccataccttggcgtaacgatacaatcaataattgacacagctaacaagaatagaatgtatgatttatatgttctacattctggtatttctccaatttctcaagaaaaaatacttaaaatggaaacccacaacacacatattgcatttgtggatatttcatcatattctaaagaaattgcatttcattctaatatagactatatttctatagagacatttttccgttttataatcccagacatatttccaaagttatccaaagtcttgtacatcgattgtgatctaatcgttctaaaagacttggcattgttatatgacatagatgtcaacgactacatcctaggggcggtaagacaaataaatagttacgataaaataaaacaaataaatagagatttaaagatttcatgctatgaatatataaatgctggcgtcctattaataaatttaaaagaatttgttaaaaatgacgtacagggtaaagcatatgctttaataaaggcaggaatcaactacccaacaggtgatcaagatcttatcaatgtaatatgtaataagaaaataaagtaccttgatgaaagttggaattgcccaggtccaatttatgaatcgatgaaaaaagattcaaatgtgcatccttctgtgtatactcaattatttgaacaatcttgcatctctccgggaattatacactacatgacctctgcaaaaccttgggatcatccagaacgtattatgagtaagtatttttgggatagtgcaagacatagtccattttatgaagaaatcctttttaagaagtttaatgcgatagagtcgaaaattgcatctttgccgacaaatgattccaagactaaaaaacactattttcaaaaaattcataaaataatatcacataaaaagagggcataatatgaaagacataacagctgttgatttcacagcatattataaaaatgctgaagaagctgcagagagacagtacaacacacacatgaaacaatttttcaaaaaatatgctccggccaacagtggattaacaataatggatttcgcttgcgggtgggggagaatatccaatgttataaaagataactatgcgaaaataatcctctgtgacatttctaaaaaagcaatagaacattgtaaagaaagatttgcaaacgacaatagatttgaattcgtcgtaaataaaattgacgaaataccattggaatccaattcagttgattttgtattctcatgggactccatggttaatttcaattatagattactagatatgtccatattcgaaataaatcgtattttgaaaaataacggatatgcatttattcatcattcaaattataggggcgcttttgcagcacaaggtttaacctgcagtgaaaattatgaagaaaataaaatgggacgggcttgcacttcttatgtggacatgagaataattgcaaaacactataatatgaaaatagtagaacaaaaattgcaagattggggaaatggagaaaatttcataagacatgttgattgtatcactatactacaaaaaatatcagaatctaaaccacatttagatgaagtattgtttaaatcaggatatataacaaagcctcgaattctaggagaaaaaatgttagatatgtcatctagtaaggaagattcggtgtcgattaatattttgggttgttgcgtctcaagagatatattcaatcttaaatgtggaataaattacaccgtcaaaggctacgtgcaaagaaactgccctcttgacatatttgatgaaatagctaactcttacaaaatatcggatcttgacgttgaagatattgtagaacataatttcaataaacgtagtttatgcactctatttaatggaacaggatctaaaaaactattagaaaacaaaggaaaatggataataatcgattctttttattcaggatgtggttgttttgaactcacatttccagatcgttcttgcaaatatatccaaacagattggggcactgtattaaaaaaattagtaactaaactagataatggaatcaaatgtaattttattgacggtaatgaaaattttttattaaaaatagacaaatttacaaatttcataaaaaacaattggggaaataatgtaattttgttagatttacctcgtaccaatcaatatttggcaaccaatggtacagttcaaataaaatcaacttcatacatagaatcaatcaatgctgcagatgaattgtgtaagttattattagaaagattggactgccattatgttcgtatgcctcatccactatatggggactcttataactcatatgatgtgcaagcagtacattatataaaagaagcttaccagtacttgaaagaagcagttgacataatcgtcaatggcgtagatgtttataaaaaacttgatttaaattatattaaatatagtcaaatctttcatgaaattgcacttggaactcgtttatctgaaagaaatacaatacaaataataaaaagaataatcgcttctaaagacgtcgttaattatcctaaatgtgttcaactttgcaatcaattgatactccaaggaagtgtagacgcattatacttgttatctgttgtatatcgtgatggactgggtgtaaataaagatattgattttgccatagagttaatggaaaaggcatattcgcagtacaatgactacggtaatgcattaattgatttattgtggaatagaaccgataccgaatcatgtaataaaattataagaattgcttcacaactattagattgtggcaatgcaggggttttttcaagatttggcagaatgtacagagatggaaaaagtgtagaaaaaaacatagatttgtctattgagtatttttacaaagctaaaagcaaagatttgtcttggagtatcgaattattcgatgttatgtggaatgcaaatagatcagaatacgattcacaactcaaaaatgcaatatccgaattagcagataaaggaaatccagatgcgatggttcgcagagggagaatgtatagatacggtagaggtgaaattaaagatttcgaaaaagccctattttggataaaaaaagctgccgacatgaaaaaaaattatgtttctgaatataatgagttaaaaactttaactgttacaatcaaataaaataagagattaatccccccttctaacgcacattgagcattcccgaggatttataagatttttttcagaccgtctggaacagttctgaacctgaatctgcggattgtagtactacaatccgcagattcaggcttcagactcttcgggctagaagaaccgaagagcggcaagattgtgctggcctgatgtaacctatacaatctgcagatttaggttctgaagattctatgcccgcgattcccatggagaattcacgatacaattaaaatgaaaaaaacattatagacatatatggtaaagacctatcaaaagccattcataattgccgaagctggctgtaatcatatggggcagatgaggattgcaaaacagcttattgagattgcagcatccttttgtaaggctgacgctattaaatttcagaaacgttgccccagagaacttcttacacccgaacaatataattcgccccatccgaatcctaagaattcttatggaaaaacttatggggagcatcgtgaatttcttgagtttacagcaactcagcatcaacaattgaaagattggtgtgatgaatttggaattatctattccacatctgtgtgggacatgacctctgcaaaagaaattgctgccattaatccaaaatttattaaaatcccatctgcttgcaataatcattacgaaatgcttcaatggttgtgtgacaattacgatggagagatacagttatctttcgggatgactacttatgaagaggagagaaacattgttgaactttttgagaagaatggtagaaataaagatcttgtaatttttgcatgcacttctggctatcctgttccttatgaagatgtttgtcttctggaattaaataggctctatgacacatttgggaatacggttaaaaagattggattttctggccatcacataggtactgcgattgatattgcagcatatgctcttggggccaccgttatcgaaagacattatactcttgataaaacgtggaaaggaactgatcacgctgcatcattggaacctgaagagttcaaaatacttgtaagagatctcaacagggtgagcatggcaatgactgctaaacccgaagaaattttacccattgagaaaatacaaagagataaactcaaatataggtgtagatgaatgaaacaattttcttttttaaacaatgttgagttactcatatatgattgcgatggggtactaacgaataataaagtcatagtagatgaatgcggaaaagaatatgttgttttcagtcgtgctgatggatatggaatctcccgtatacatgagatgggtatcaaacaagtggtcatatctactgaatccaatccagtggtgatacaacgttgtaataagcttaaattggctgtattaaataatgttagtgataaatcaatagctgtaaaggaatattgcaagtctctggatatagatttaaaaaatgtgatgtttgtaggcaacgatctgaatgatttgaatgctatgaatattgtaggatatcgtggttgtcctgcagatgctgaaccagaagtgctctccgaatgtaattggatttctttgaaaaatggaggagatggagtcataagagacctatatcgcaatatttgtgagtcgaggatgtaatcatgtcaattcaaaaaggacttgtttatgcaataattcccgctcgctctggttctagttctgttaaagataaaaatatacgcattatttctgggcaccctctgatggcgtacagcattattgcggcaagactttgtaaaaatattaacagagtcattatgactactgattctgaaaaatatgcaaaaattgcaaataaatacggtgctgaaactccatttttaagacccgtagaaatatcagggaagtattcaactgatctagaatttgtaaaacatgcaattgattggtttgaaaaaaatgaaaaattattgccagaatattgggttcatctccgtccaacatctcctctgagaacaccctcagagattgatcgggcaatcgatatctttaaaaattcaaaggcagactgtttaaaatctgttcatcttacacacgagtgcccatacaagtggtttaatgttactgaagagggttatttgaaaacaatttgtggaatctctttggatgaagctaatggtccccgtcaaagttatcccccagtatttgttcctaatggctatgtcgatattgttagaactgaacagataattagatcaggcacattgtatggaaattctgctgtggcttttgaaacaaatgaagttattgatattgattatgagcatgagttagatcagctgcagacgttaattaaaacgagtggcggcatagtgagtaatgaattaaaaaaattcgagtgaaatcatggcattagaacgtttacaaataaatgaatctgtcaatatactggatacacttcgattcatggacgagaatcagaccaaatatttgattgctgttaatgaaacaggggttgtaattggaactttaagtgatggagacattcgtcgtgcaattattagagggtgttcacttgaagaacccatatctttagcagttaaccattcatttatgtatgttctaaaaacggatagtattgataaaatactgtcaatttttcatgagcgtaaaatagaatttataccaattctagatgaaaataagaaactatacaatgtgatgactaggcatattttgaattacttgttactcatcaatcagaaaatatcttttgattttgattatgatatgttgtgtaaaacagttttagagcatgaaatttatgttagaccttggggctactataaaacaatggttttaaatgatacatttcagtcaaaagtaatttatattctgccagagcaacgtctcagtcttcaaagccatgaacatcgtgaagaatattggattataatcagtggcaatggtcgtgttcaactgggagaatccacacatcctgtaaatcctggagatatgttcttcatacctaagggatgtaaaccagcatatccaatgaatcaactgaagaaattatggtattttctgaagttcaacttggtgattattttggcgaagatgacattaaacgttatagtgacatatatgggcgcaaatgactaatgtttaattcttatgtggattcggcatccctcttttgaatttccttgaatgaaaaaataaagcgtgaattcggcacgttgaggaatcttttattttcggcgtgaaaacgtcgttttttctgcaggatccagggtgtttttcccgggttttcatgacggtcggcatagcgtccgctgaratatgctgcgtaccaggtagaggaacacgcgcacgttatttatagtttagcgattataatcgagtaaaactcgattataatcgctaaaaattcaggagacgcgcgtaccctgcgatataacgggcttgatgaaracatacagggtaccgccatggcattggaccgttctagggacaggggatacgtcggcctgagggcgacgtccgcgttagccatggcgctgttcgaacaatccggtctgagaggactgttggacgaaaggatccccgtggacaaacgtcgcaagctcagcataggatatgccgtcaaagccttcatcggcgatatgatgggtcatgcggaccgcagggcactgagcagggtctccgacccgttcatgtccgctcccgtatccragatgttcggggagaagatggatctggagggattgggtgcaaccgcattgtcaagggacctcgatatcatgttcgaggccgatcttcctgctgtcacctatgactgctaccgtcttctggcctcaagatacgggctggattcgaacatcttcaacatcgattcgaccaacttcggcatatccgcgaaggagaagaccgccgatatcgagggtgcggcagtaccggaatggtgcggacatcccaaggattcgaaggccaggatagtctacagcctcctttcggtcacggacgagaacagtatcgtctgctacgaaagaccgtatgacggtgccaccgcggattccgagatggacaggggtgccatagagttcctttccggtaaggtggatccctcctcgaccacattggtggccgattgcaagatcgccaccgctcccctggtggggctcatgacctccgaggggttcggtttcgtagcgaagtgcccggagaacttcgggcgcaaggtgagggacgatatcgtttattccgtatccacgggaacgatggatccctcatccgtacgtgacggatggagatatacgatacggatgccgaagtggacgggatgatgctgaggttcgttgcctatcgcacatccgatgatatccaggcgggtatcgagtaccgccgggaacaggatctgaaggaagcgcaggcgctcctcggtcgtttctcctcgagactgttcaactgcgaggaggatgcacgcagggccataaccgaagcattggggaacctcagcgattcggcgtacgaggtaggttggtcggtatcggaggtggaatcccgttcctacgggcacagaggaagaccgaggaaggacgagaaaccgaccgtgagaacggaataccgggtggacgtttcgctggagttcgacgaggagagagccaaggagctctcgaaggaccgcagcgtaagggtcctggtgaccaacctgccgagagcgaacggggacgcggagaacatccgcttcggcgcaacggcggatacggtgctgctcacatacctggggcaataccacgtggaacacgccttcagattgatgaaggacgggatgtccatgaagaaggtgtacatccagaaaccttcgagggagaacgcgatgatgttcgtgatctcgatagccaccatgctcaccgaccttgcggaccatgttctcaagagggaaggcgtcgataccactttctcggatttcgtgagacgttccgtctccctcatcctcgccagggatcccgtatcgggtgacgagcacttcatgggcccgtccattctggcggacgagttcatggatgtatcggaagcgttgggcatcgatacggacaggctgatgtgctaaaggagccggaccctgtgcagtaacagcgtgagctatggccctggtcaaaaataatcagggcaacgtgccgaattcacgtaaaggggtatagggcccatgttcatattaataaaagacattgttgaaaaactatatactgtaatacaaatgcatacataatgttatattgtctaatcgtcggtgccggaatctcaggatcctccattgcaaacatcatctcctccggatccacagactgcaaaatcaaagtcatagatgaaaaaaacgcaataggcggcaactgtttcgactacctcgacgaaaacaacataatgattcacagatacggatcccacatcttccacacttctgacaaaaaagtatgggacttcctctcgcaattcacctccttcaacacctacatgcaccgcgtatacgcggtcatcgaaggcaacgaggtgcccatcccgttcaacttcgacagcatccgccgctgcttccccgaaaacctcgccgacaggatcgaaaggaaacttctcgacaggttcgaatacggctccaagatccccatccgcgacttcatggaacaggacgacgaagatctccgtttcctcgcccaatacgtctacgacaacgtcttcgtccattacaccgagaaacagtggggcaaggacccctcccagatagacggcgccgtcaccgcccgcgtccccgtctacctcagcagggactgcagatatttccaagatacctatcaggggatcccctccgaaggatacaccaggatgatagagaagatgctcgacagaccgaacatcgaagtcaaactcgacaccgatttcaaggacatagagaacccggaggaatacgaccacatcttctataccgggccgatagatgagctgatggattactgcttcgggcccctcccctaccgcagcgtacatttcaaactggagacttacgacagggagcattatcaggacaatgcagtggtgaactaccccaacaactacgacttcacccgcatccacgaatacaagtactatcttaacgacagatccgacaggaccgtcatagccaaggaatactcggaggacttcgtgatcgggaagaacgagagatattatccggtacccaccgaggaatccgccgaactgtactccagatatctggaggccgcgaaaaggaagtaccccaacatgcacttcctgggccgcctcggggacaataagtactacgatatggataaagccgtggcaagggccatggaagtctacaaagaggttttcgaatgaaggtcatggtaaccggaggggacggctacatcggcagccactgtgtattggccctcctcgattccggatacgacgtcctgaccttcgacaaccacagcaccggccacatacagacttccgagaacatctccggcatatcgacggaaggaaggttcctcgggaccttctccggcgacctcctgaacgtcgatgatataaacagggcattaaaagagaacgacatggacgccgtcatccatttcgcagccttctcccaggtcgccgaatcgatgaaaagacccgatatctactaccgcaacaacgtctgcgggacgatgaacctcctggatgccatgaaggaccatggtgtcgacaagatcgtcttctcgtccaccgcagccacctacggcgagcccgagtacacccccatcgacgaagaccacccccagaggcccatcaacccctacggcaggaccaagctcaccgtcgaagggatgatggacgactatgacctggcctacggcatcaggagcgtacgcctgagatacttcaacgtggccggtgcggactccggatgcagggtgggggaatggcacgatccggagacccacctcatccccaacatcctcaaatccaccttcggcgacggaaaggagttcgagctcttcggcgacgactacgacacccgcgacggcacatgcataagggactacgtgaacgtcgaggacctggcggacgcccacatattggcactggaatacctcgtgaacggaggcggaacggacttcttcaatctgggtaccaacgaaggcagttccgtcaaggaggtgttcgccgagtgcgagaaggtcaccggaaaaaagatccctctgaagataaagggcagacgtcccggggacccggcagtactcgtggcagacaacaggaaagcgaaggagatcctccactggaacccccgccgcacattgtccgacagcatccgcaccgcttatatgtgggaaaagaagatgcgcggtaactgaacaacatgtcccggaacgaggtcgtcatacagcacatcgtcatgccctccggcatagtggaaggagacatcccgctgtacaacagaaattccgacggcaggcattttccgatagacctcagaaagggggagaccctcgacctccgttcccatttcaacctccttccgatacgcaaacttagggagaataccgaaaccgggaccatcttcctcagattacatttcaaaggatccgtttcggtactcgtcacgacatacggtcccgggacagaaacgtccgaggatgccatcatcccatccgacagggagtattgcatcatcgatggttccgaaggagacctcctggggatcgtcataacggcgatgaccgattccgtcctggaatccggggagttcctgtgccggccgcaatccaggaaagacgtccatctggcacatgttatatgcacctatcacagggagaaggaactacgggataagctggagaggatcggttcgttcctcaataaggatccggacatgaaggaacacctggagatcttcatcatagacaacggccgcaccatcaaagacatcgaaagggggaacgtgcgccttatcggatcccccaactacggaggaagcgccggattcgccagagggatgatggaggcctgcagggacgggaagaccacccatgtcctcctgaacgacgacgatgcccgtctggatccggagatccttttccgtacgatatcgttctactctctgctgaaagacggattatcggatacgatgctgggcgggaccatgctcctcctggacagaccttgcgaaacacatgaatccggtgcggtcttcaaaggctccaaaccccattccttgaaacgccacctcgacctttcggacataagttcgaacgaggaactcgagcgcgaggagagtatcgattacttcggatggtggtatctggctattcctgcagagaccatcaaaaagaacggatatcctctgccgatgttctacaagatggacgatgtagagtacggtctgaggtccccatcgcgcaaggtcaccatgtgcgggatatccgtctggcatccgtcgttctccagcagttattccgcatccggcacatactatgcccatcggaacgacctcgtcctcctcgcctgcaaccgtatgctcgacagaaggaacatagacgaattcatggaaagggcgctcctggataccgcatgcctcagatatccgtcgacatccgccaccatgaaggcgatagaggatttcctcaagggcccggataccttgttccgcatgtgtctggacggacctgccgggatcgaggggtacgagtatggggatgtcggagaactgagcgtcggactgagaccgggaaaggagacccgtgccggattcggattccgcaaatacacactcaacggcctgttactcccatcatccggggacgtaataacagatttcgacaatatgcagacgaaggacttctaccgtgtcggtaaagcactctacgtcgtcgatgagaaaaaagggactctttgcaaacgcagtcttacgaaagccatattccagacggtcggactccatatcctcaggagaaaactgatccgcaacatggagaggttaaacgaggaatacgggagggcatccgcccgctattcctcggaagaaggttggaaaaagttgttcggcgaagaatgacctcatctgttgaggaccgtcttcatcctggtctttatatccactatcggatcgacattgcagggatctatgccgtggagggcggcgatgtagagggagatgtggtcgccgaccatgatcccgtagatcatcctctccaggagggactcgcccttggtgtctatgacggacacggggacgtccctgctctccaggaggtccagcgtggccttgaggatcttgctgatctccaccagcctgtcgtcgcagatgacgaccggcatgaacttggtcctgtaggggtcgtcgtaccatccgacgacctcgttgtggttgaactcggggacgacgccggagaaggcgatgatcttggagttctcgttgagctggttcttcatgcggacggcgatggcctccatgtcgggggcgccgtacacgacggggacgtggccttccaggtccttcgcgatcctccaggcgatgccgtcctccgcttccatctccttcctgtaccccctaagtctgggaagcatggactttatctgatgtctgagacctggacctccggcatcttcgatgatcgtagcaagagtcccgatgaaccacccgatggcactgcggggctgcatggatcttccttcgatcaagatcataggattcccgttctgttcggaaagctccttcagggtacctccgtgggtgaccgctacgacatcgagacctgcgtcgagtgcgagcttatacatgaagatggtctcgtaggtctccccggaatagctgcaggccacgaagagggtgtccttgtccacccactcgggaagatacatggtctttgcgacatctacagagatcttcgaagaataatacatggagtcggcgaatatcgcacccccgatggcggaagcacccataccgcatatcagaacgtgtttgtatctcttccttacacaggaatccacggcgatcgcctcggagagatcgtcggtaaaccccgaaatctcctcggccatcttattcaacgaatcggtatcgaaatccatcattcgagctcccccaaatactccaaaaaacgcttatgttattttgacagagtatgtatgcatttaaaataatattgtgcagacgtcgacgattgcaaggtctggcacatcaccttttcctatgggaatagagaacctctccgatcttcatgatgatgacacaggggatgtccgacaacctcaggatcagatgcttgtatatgctatgctgagtattcacagcccattttatcccggaaagggtgttcgggtcgttaccgctctcctctgccatgaggacatccatccacccgtccatgaccttccccgatacggaagggatgcggtctccgaacatctcggaatagaatccggtacagtccaatatcccgtcatatatctgcgggaacgcccttatacgaatggtctcgtcgttcgggacatcctcctcgaacacaggtctgccgtcatcccctatgtccaacagcggcctctccccgcttcccagaaaatattccgccagattgacatatgaagagcacaggtgctggcgggaacggtcgcaatatgccagatgtttctttttcccttccgcggtcaccgcataatagcaaccggtgacatccacatgatccagatacctctccacgtccccctgggaagtgaatttcatagtcgtggcatccaccagcatgatcttccctgcatcgcctacggtcctcttcagataattatcatagcgggcatgtccctccgccatgatcctctccagaacccccctgttctcctcggcaaaacgcctgtattctgatttcccaggaacctcgatatcccgataccggccgctgtcccggagatatgccataagcgacaacaccgtatccctgtccgacaggtccctccttccgaagaccttggcgatcatccgagaggtgtgcagatagacaaacagctttttccctcccaaggcctcgtacaccttcatcggcatgtaaccgtcgcgggagaagaaaaccagcttgtccatgtcctccgaactgtccatgacgaacttcgcgaacatgatattcatgggtccgccgaaacgcctcgacaccatgtgccagtatgtctcatccggatgttccacccatcccagcatatccatcgcaacgatgacagacgactcatatccgggatatcttttcaaaaacctcatctcatgccggtggcttgcggcatacctctccttcatcgggatccaacgcatcgccttcaaacccttggaaatggcggaatcgcagtcggcatgcctgttgtcgccgatcatcagtaccttggacggaggaagacccagatcccccaggaccatatcgtacatgagtccgctgcgtttggataccttggtctccgtggatacgtaaatcttggaatgaccggagaaaccgttcttggataccatcctctccaggatgtccgagggaagatacatgtcggaaacgagaactatattcttccctttttccgaggcgtatccgaagacctcgaccatatcgggatcggccctggagaacgatatctcggaccctatctccgcatccttgagtgccagatacttcggatctatagaacggtatatcccgtcgatgtccgtctctgggtccgtcctccgggcctccctctccgcccttatccgggcctcggcgaatccttccagcccgctctcggcctccaggaatccgaacaggtcgtgcggatggaagaaaggtctcacaagaagcgtatcgaagatatcgaaggccaccgcatccgcggtatctatggccttcagatatcccgagacatccataggacatcattccgcgttggcgaggtccttgacgaaactgtaataggcggtctccttgaacttggagacccattcgagaagctgcctcttggtgatgtatcctctggacaaagccacctgctcgggacaacccaccatggccctgccgttcttctccacgtcgtggatgtagttgctggccttaagcagggtctcgaaggtgccggtatccgcccaggcgaccgactccggaaggggtatggcatgaagtctcccctcctccatgtacatcctgttgatgtcggtgatctccaactcgcctctcgccgatggcttcagcttcttggcgaacctcacgacgtccttgtcatagaagtacaggccggtcaccgccatatccgatttgggctcctcgggcttctcctcgagggagacgaccttcccatccttatccagttccgccacgccgaaggcgtgggggtcggccaccttcttgcagaacacggtggccccgtcggactcggccatggcctcagccaggagctcgtccatatcgtcgccgcagaatatgttgtcgccgagtgcgagtgcgacacttccgccgtcgatgaaacgttccgcgatgaggaacgcatcggcgatccccctctgtaccttctgtacggcgtacttcagcttgatcccaaactgggacccgtcccccaggagccttttgaaatacatcctgtcatccttactggtgatgaccattatctcggtgatgcccgcgctcatcagagcggacagcggataatagatcatcggcttgtcatacacgggaaggagtaccttcgatacgtgctggctcgccggatataaacgagtgcccttgccggcggcaaggatgattcccttcattatcaaaaaggatagttcaatccctatataatggcgatgcacaattctttataaacttaggaatataaatcgacgatagacgtatgaaaagtaaggcgaacgcagtaatacccagcaatcgtatgaaacgtacggcatatacatccatacagccttctccaatcgacatacgcagacttgaagatgaggatctacacacttcgacggaacaaactttttatcaatagagcgaatcgggggacttaccagcgtggggctgtggggtagcttggtatccttgtaggttcgggacctattgaccccggttcaaatccgggcagccccactcatgtcggttcttcacatccattccattgttccagatcgttgcggatcgtattgtagttgatttatcaactacaatcccgtatctacatacgacgtaagaagacctgtctagaatacagggataaacatcccctccgtgaaaaacattatacgccttccacccggataattccttccgacaatgacaggaaaacccatacaagacctcggcggcctccatatcatgaccgccgaagacatcccctggttcgcagcatgcaccgccgaggcctaccgcggatacccgctcttcgaccacctgttcggtcctgtgtacagcccctccgccgtagaaaacatcttcggcgcgtccataggtgctcccgcggtctattgggcgtctcggacacggccgccgcggatgcggtggccctgttcctgccgccgggggccaagggtccatccaccgccgggttcctcgcgcacggaggcctgggactcctcgtctccgccggtctcggcaccgtgagacgcctgtccgcctacgaatcctactgcaaagaggtcatgggaaggcacaccgacggggatacatggtatcttttcaacctctgcgtaagaccggagtgccaagggaaagggctctcgtcgaaggtcatgaggcctgtcctggagcacataggggacaggggacagagatgctacctggagacccagaagggatccaacgtcggcctttacgagcatctcggcttcgaggtggcggaggagggcacggtaccgggttcggacatcccccatttcgccatggtctgggaaagcggaagacggtgacaccggaaaggagtcgcatgcagggatcgttcggattcgtgcagaagtatgcatcggcgaccctgcagacccggcacgatccgaatgtgccagcgatcccgaatggatacatcagggtccaaggaccgtgacggccacgacatacaccccgtcgttgcgcagataggaatactccgtaagaccgcatatgacgcacaggacgtcgggaatcctgctcgccccgtgcttctccagagacttcctgaaatccaggaggttcttggccgcatcctcgatctggttggcccccagttttatctcgaacgcaccccatcttccatcgggaagctccactatggcatccacctccctcccggagtcgtcacggtaatggaacagtcccgcacccatggtatcggcatatatcctgaggtcgcgttcacagagcgcctccaacagatactccgtggtcacaaggtcattcatcaggcggtccttccccgcccctaacgcagctgcggtcagggaagggtcagccagatgcctcttggccgtcttcccgacctttatgctggacctcatttccggatcgaacgcaggctggtcgtccgtcaggaacatatcgcggaatacacacagatagtctatggccgtgtcatatgacaccgcgctctccgaccctatggtcctcccgggtaggatgaggggtccgtacctttcgaacggtacgcacgtgtccctgcagaccttggtgaccggagaagggatgcactcgctgcgcgcaagtgccttcagcacggatctgacgttggattccttcctgcgcatcccgccgaacaccgaggcatcatggacggaacactccagataactgcggacgaaccccaccctgtcctcggacgagaggccgatgcaccccggccatccgccgcctattatgaggtccacgagacgttccagagagacagggttctgcacgaactccatcgatccgcccgacatgattgtcctgagggataccgatccgtcggaatcccccgactcgtacagggacatcggacgcatgcgtatacccatcatacgtccattgcttttttcgatcagggaacgtgacgtctgaacggacgacgaggtcgatatcgggcccccattctcaaggggcgtgtcccgttcggatcctgcgatggcctctgtcccggcaacgtcttgatacgcatcaatagggtgcggtccagaggatacggtctgcatatccatggcccttggccaacatatgtcggcatccttggaaatggaatggccgtccgaatgtgccagacccgtccatgtcttgccacatcccctcggtccttcgatcactacccctccgaaagaacgtagggactcctccaccatcccatccacgagtctggatctatatccttcgggcctcacaaccatatgacaggataagagtttccgatatatccattcctaatgtttcggaaaatccattcctaatgtttcggaaaatccattcctaatgtttcggaaaatccattcctaatgtttcggaaaatccattcctaatgtttcggaaaatccattcctaatgtttcggaaataagaccaataagtaacttaaaatatgttatatatgtcccgcatccccaccgttcggacgagacgcataccggatgtaatgtggcggaggatcaatccgcatccaatctcccgtccaccacgtggtcctcgccgatcatcctcgacaggaccgtcctcgcggccttcacgctgtcttcccctccgttggacgccgtgtagtacatcagtaccgtcacatcgtagccgaggtcgaagaagtccgccgcgttcttcaggacgcagcagtcggaatccagtcccgctatgtacacccggtccaccccgttctcgtggaagtagtcgttgatcctctggcacactgcggagtaaccgttcttctcctcgaccccgtcggcggcctcctccacgaaatccaggacgtcggtgtcgggagaggacatcatccccctccatcccatgtgcctgacaaagggggaacctggcctgttgacgaacttggtggccacgatgtggtcgaatcccatgcgtacgagctccttcagcctcgggaccacgtattccgtcctctcggtgacgaatcccttctgtacgtcgatgagcagaagacagtcggacatatgctccgtatattgtcgggcatctttgaaatacattgcaccggggatcccgtgtagacatccttttaatccgccgtccgcttccgcagtgaccatgaaggtacttctggtcaacggaagcccccatgagaggggctgcacctacacgggcctctcggaggtcgccgggaagctcgaggaggaaggggtggagactgagctcttctggatcggcaccggggatataccgggctgcagaggctgcggcgcctgcaggaagggcagacgctgcgtcatcgaggattccgtgaacgatatcggggacagactggacgagttcgacggcatagtcttcggatcgcccgtgtactactccggtccggacggacagctgtgctcgtggatggaccgtctgttctactccaatcagaagaagatgtacgggaaggtcgccgcggccgtcgtcaactgcaggcgcggaggggactccgccgccttccagcgcatgaaccagtacttcctcatgtgcaacatggtggtccctggatcccagtactggaaccagatccacgggttcacccccgaggacgtcatgaaggacgaggaagggctgcagaccatgcgcactttggcccagaacatcgcatgggtactgaagtgcatggaggccggcaggaaggccggcatatctatgcccgtgtacgagaagtggacccccacccacttcatccgctgataccgccacggtcagacacgatgtgccagactcctgacccaggcacgtccgcggacgtacttgctcaccttctcctccgagaacaggtagtcgtcgacgagggtcgagaccagcctcatcatctgacggtcgtcgcctatggggcggtccatggactcgaactccagttcgtagaccggtacgctcctcttccccgtggccgggtcgcggaagaccaccctgtcgaagtccatggtgtatcccatcgcctcggaacggacgggacatcttatccgggacacatccacacggaccttggggatgggatctatgtcataatgacccagatacctgtcggcgtggtcctgcagggccttgatgcggtccattcccgggatgttgagtacctccgtcttcacctgcctcctggacagccccataccgttggtgacccccggaagcttgaggatgaccgcacccatcatccccgaatccctgtatctgagcgagacgtgcttcgaatcgaacgtatctccgacatcggtgtagtagtcgtcgatgtagcggatatcctccctctccccacaccggaatccggttttcgaaaggacggcccctatcatcctcatcgcatccgctgggtcttccgaaaaggcgaagatcccgccgtcggagtaaagcttgatctcgttctccgtgcggatgtctgtcatggataggtcatcatcgtactggaataaatacggcgggacggtcagaggaccccgtcccgcagaaaggcttttcgtcctgcggcacatggcaggactccggcggccagaacctcgaaacagggtgaaagaggactgcggccgccgtggatgaaacatccgcccatgaggagataaatgggattgcgaacattttcatcctctgggtctcccgcccgcaaagggcgggagcatgggtttcagacgcgggatttgatcgcatccaccatggcgcggatgttgtctgcgggcgttccgatcggcaccccgcatccggcggatattatatcgaatcctgcgtcggcagaggcgttggccgcatccgccacatccttcggggtccccttgaacagggggaaggcgcaaccgacgttcccgacgaggacgcctctgtcgtcggcgatctccaccgcctccttcggagggaccttctcctccacggatatccccgtgaccccggtgtcgtacatgtacggtattatccccctggagtccccgcatatgtgcaggattgtcatccccgggaggtctcccagtgcatgcttcacgaactgtccgctcatctgcgggaagtcgctcggcgacaggatgtcggttgatgccgacggctcggacatctggacgacgtcggccccgttggccaggagggcctcgccgaaggcacggcagtaaggtgctaccgccttcacccatttcttggccctctccgggtccgtccacacgctgtatatgagattctccgcattcaggaggtgccctgcgagggtgaacggtccggtgttccctccgaccaccacgtagtccttgccatgggtcttgtgcatgatccccatcgcatcgacggcggtcttcaccctgccgcccttgacgaagtcttccaccggcatgaattcctccatcttctccggctcgtcgaacagcatcttctgggggtcgtacgtgtatgggtgggagaggatcatgggggacgacgtcttgccgcccatcctcatcttgcaaccgagtctctcggcctcctccgtcaggcagaaccccgccctcacggactccagaccgaagtagtccgcctgggcgcagcccagggcggccatcttccgggggtccgagtgcgcctcgggccacgaggccccgcaggcgtccatcatgtccaccgtgtcgcatgtggtgaacaccgccaccgggggcctgtccaaaggctccttgtgcatggcggccagtaccctgtccctgcagctcatcgccatctcacatcacctccttgagccacttgacgcagttctgagcatcggaatccctgtggtccgccccgatctccttcgcgaacccctccgtcgtcggaggtcctccgatggtcacggtgcagttccccctgtacccgttgtctacgagtgccttcaccgcggccgccatgttgtccatggtaggggtcatgagggtgctcagacagaccacgtggatccctttatccttcgccgtatccgctatgagattcggcgatacgtccttccccaggtcgtccaccacgtacccggaggcggtcagcatggtcttcactatgttcttgccgatgtcgtgtacatctccctggacgaccgcggtctcggcctgtttggtgtccttcatgtccgccttgggtatggcgggcagtagaacatccaggccgttgtacatcgcatgggcggccaccaggacctgcggcaggtacatcttgcgctcggcatagttgtcgccgatcacacccatccccaccacgaggccttcgttgatggcctccaccgggttcaaaccctcttccaaggcgcgtctggccgccacggtcgcacggtcgggggcacatgccacgaccgcatccgcgagttctttgagtaaggctttcttatccatcctagttcctccagcagaaagaccggtaagatatgccgtccccccacttgataaatcaatcttaatcggagacgataaaggatactacgaaccgttcgtatcgtatgacaacatgtgaggagcggcggcgggcccggctaggcccgcctgatgaggagatcccgcggtccgagaataccgcgagcaggagccgcgggaatccgcggtctctgtaggtaatatcatccatccaacatatagaagaaactacgaacacgttcgattccgagcgatattgcgtaaaaatagaggggtatgcccgctccggggcacccccttatgtacagtttataaaagaactcaattcctgcgggccgacttgtcggacccgtctatgtaattacagatgagcttcctctcggccgtcctcagcgccacgttgagggtggacttggagcatccgaggatctcgcacagggcgtcgaggtccatcctgcgggggacgttgtagtaacccctgtcgaaggcggccttgaggtacttctcctccttgggagtcagggtcatatcgtccccgaacttccctccggcctggaacttgacacggtatccgtactccttcagggaggcgatgagcttgtggacggtcacgctgtcgggaccggctatggtccactccacgatgttgccgtccacggggacggaggacatcaggaagcacttgctcttgctgatgagcgagcagatgtagcaactcctgttggtcaccatggcggtgtagtgggtggagctgatcctctcgatggtgcaatcgccgaggtcggtggaggtcacgccctccggtatctcggtcttcccgtcggtgaatatgcggatcatagagatcccctccccgtcctctgtcgaggaacacttcaggacctgcagggatatcccatcgttcgtgtggtccacggggaccatcttgcggcacggatgctcctcgtaaggcatacttctatcaatcatcaatctgcaataatacaattgtaccgcaccccgttgtctttctaacggaatatgtatctgtcccgtccataaatatagttgtcggtatggatactggatggatatattgtatgcttggatgaaaacatccgtaggccgcttccccgtacgtccggacggcggcacctgctccgaggaccgcaggaagacatcgggacccagagtgaaaagaagaaaggagaccgtcccccggaggggacgggtcgtgtttcactgttgtttcgcggcggcagcgtccacgtagtccttccagaccttctcgaggtcgggcctctggacggtctcgatgacgtacttggcgaactcctcgccggtggcaccggtgtccctgccggtcatgacgagcctcttctcgaactggacgcagacgtcgagggccatgtcgagcttcctggccttctctacctccccgatatgctcgagcatcatggcgacggccttgatcatgctgcaggggtccgcatacttggcacggccctcgtcgaccatcctgggggcggacccgtggatggcctcgaacatggcatacctcttaccgatgttggccgatccggcggtaccgacgcctccctggatctgggcggcctcgtcggtgatgatgtccccgtacaggttggggaggacgaacacacggaacgcggacctcctggcgggatccaggagcttggcggtggtgatgtctatgaaccagtcgtcccacctgacctcggggtagtccttggcgaccttctcggcgatgttcaggaacttcccgtcggtggtcttgatgatgttggccttggtgatgacggacacgtagttggcaccggatttcttagcgtagtcgaaaccggccctgaggatcctctcggtaccctgggtggtggcgacgcagtagtcgatggcgaggtcgtcggtcacgttgatcccgttggaaccgacggcgtaggaaccctcggtgttctccctgaagaacctccagttgatcccgagctcggggacggaaacgggtctgatgttggcgaagaggtcgagctccttcctcatggcgacgttcgcggactcgatgttgggccacgggtcccccttcttgggggtggtggtcggacccttgaggatgacgtggcacttcttcagctcctccatggtgtcgtcggggatggccttcatgacctccacacgcctctcgatggtgagcccgtcgatgttcctgacctcgaccttgccggccgcgatcttgtccgccaggaggaactcgagcaccttcctcgcatcgttgcagatgtagggcccgataccgtccccgccgcagacgccgatgatgagcttgtcgagtttggagtagtcggtccagtcgggttcgttcttcagtctctcgaccctttccagctgcttcctgagaagttcgccgtactgtttctgggccgcttcgatggctttctcgtcaaccatgtttatcgtccacttcattggaatcgtgattttaaaactatgcgtaacggatgtaaacaggcccggatgaccgggggacggccattcctggcccgtcccctccccggactcctgttggaccccgccgcatctccgatgtcgtgtactatgtcgataccgcatccgtaaccgacaggatatgggccggcccccgtctcataaggctgggagggaagactcggatgcgaacgccaggacccccttcgttcctgcagggatggacaccggaccgacgacatgggaggggaaaggcatacgggtcagacagggggtcgtcccgatccaaggatgcgtagtacgggacggcccctcctccggaccaatatttttaaccgaggctcccttccgggacccagtatgcttttcagagccgaatcagtcaccaaggccttcgggcccaacaaagtactcgtcgacgccaatatccagatcaacgagcacgacgccatcgggctgatcggcgtgaacggggccgggaagtccacattcataaagatcctcctgggtatagagccctgcgacaccggggagatcacccgccgttccaagaacatcgggtatctggaacagttcgccgaatcctcccacgttccggtcagggaggtcctgggccgcccctacgggcacatcgagaacatccgccgccgcatggccgccatcgacgaggagatggccaacggaggggacctggactggaacgccctcgccaccgagtacgccgacctggaacagaaactggccaactgcgacgtggccgacgagaacaagctcagggacgccctggagcaggtgggtctcccggccgacatgatggacaggttcatggacaccctctcaggaggcgagaggaccaaggtcatgctggccaggatcgtcgtccaggcggaggagtgcgacatcctcgtcatggacgaacccacctcccatctggacatagacaccatcgagtggctggaggactacctcctccgcagccactgcgccgtactcgccgtctcccacgaccgttatttcctggataagatggccgtccgcatggtcgagatcgagaacgggaagacccgcgagtacaaggggaactactcccagttcgtcatgaagaagatgctggacctccagaggcaggagcgcgaatgggagaaatacaaccaggccaagcgcacgcaggaggccatagcggaacgcctcaaacacgaccagtggtacgcggccacctacaagaccagggagaagatgatcgccaagatggagatcaaggagaaacccgaagagctccgcgagatcaccgtcaggatccaggcggcccataagtccggtaagaacgtattcatgatgaaggactgttccatcgcctacgagaaaggtcagccggatgtgctggaacatgtcaatctggacataaggaaaggcgataagatcggcatattcggggccaacggccagggcaaatccactctcgtaaaggcactcctggaggagatcccggtcacctccggggaactttggaccgcccccggcaacaaggtgggctattacagccagcaccacgaggaactcgacctcaggctcagtgcggaggagcagctcctggtgtacatgggcaaggaacgcagggccgaggcacgccagatgctggcccgcttcctcctcgtcggcgatgcggtcgaccgccccatgtccaccctgtcggggggtcagagatgccgcgtggccctcgccgtcctcctcatgaaggagaccaacgtccttatcctcgacgaacccaccaactacctggacatcccggcgagacatgccatcgaggaggcgctgaacgaatacgacggcaccatcataaccgtcacccacgaccgttacttcctcgactcggtatgcaccagtgtcatcgaggtcaaggacgggagggccataccgtacgccggcacctattcccagatgaagggcaggcccaacatcaccgagatcgtcatggacgccgatgaatatcgtgtactggcacctttcaccaactgggccaccggcatgaaatacaagaagggcgacagggtcctcgtggcccccaacgagctggagaactaccaatgggccatcgaccagggcaaggtcaagaagaccggcggaagacagaggaagaaggtggccgtgaaggacccgcagagcggcgaatgaggtgtttatgatgacgaggatcggttacatgggcatccccttctccaacagcgaggagatgtcccagatattcgcgagggagatggggttcgacgatgcggagcacgtccccttggtcacgtccaaggatgtggtggatgccctctgcaacggaaaggtggactacggtgtcgtggccgtcaggaacagcacggcgggaccggtcctggagacgcagaggtccctcgaagggaaggatgtaaagacggtgagggagggggatctgcacatacatcactgcgtcttcaccaaaagggcggacctccgcatatcgaaggtcgcatcccacatacaggcgctgggacaatgcaaggattcgctttccaggctgtatcctggggcagagatgatagagtgtaccgacactgcatatgcggccgagctcctggccgaaggaagacttcccgacgactgtgccgtcctatgcaaacgttccgccggggagcattacggactgcatctggcacatgaaaacatagaggacaggaaggacaacaccacccacttctggctcatatccctctgaaggtttcggatcggaagaggacagcctttaaacctatagactcatatgtcgaggtatgaagggggaagacatacctctacggagtgtgtctccagaacaagaaggcgaaggtcctgttcgaggaactggatctctgaaaagtcaccatccgcagataagggtcatagcccttcgatatccatgcctatggacctcatctgctcggggaatcccggataggatacattccagcatgcatcgttctccatagagaccggaccgtcggatacgagagaagctaccgcggccgccatcatcatcctgtggtcgccgttgtgctcgatcctccctccgtgaagtctctccaccccttcgatgacgcacccgtcctcggtcccgcggatatcggcccccaaggtcctcaacatgttctcggtaagggcgatcctgtcgctctccttgaacctcaaatgaggagcgccgtacagcctgctcctccctttggccgtactcagaaggacggcgaccacggggaacaggtcggggatgtcccccatgtctatctccgcaccttccagcctgccggtgttactgcaggtgacctcgtcaccggagacctccacatcgcacccggcctccttcagtacgtctatgatcttcctgtccccctggggatcggacatgtccatccctctggcggtgaccctgcctgcgatccctcctgcgaccagcgggaatgcggatgacgagaaatccgccggtacgcggtaatctgtaggcatgtagtgctgaggctcggcatggaagacgttgccctcctccgtgacctccacaccgaacttccccatcatcgaggtggttatgtcgatatacggtttggagacgaggtgcccggttatgcgcacatcggtagggcgtccggtgagaggggacgacatgatcagcgaagatacgaactgtgaactgacacctccgtctatgaccagttcgctcccggttatgggtccgcggacctccacggggggcttccctccattggatgaacattccaccccggctgcggagagcgaatcaagaaggggacccatgggtctcttctgtatggaggaatcgccggtaaggacgaccttctcggagaaaagactggatatcccggtcatgagcctcatggtcgtaccggagttcatcacgtcgatggtacggtccggggcatggatgctttcgcattccactgtcacggatccttccctttccgtcaccacggcccccatcgccctgaccgcatccatggtggcccgggtgtcgaaggagatcagcggcgaggagacctcgcacctgccttcggacagggccgacatgattatggccctgtgggtatggctcttggacgggggaggggagaccttcccctcggcccttcctcccctgaaaactatgtctgacatttatctcgtctccgtaagaatggtcctgcaatccagcgcctcggctatccttccgccctttccggactccgcgacaaccgctatggccggaccggtaccggatatcccggcggccaacgcaccatgtgccagcgcatcgtctatgagttcttcgctctctcccgttacacgggctatgagcctgccgttcatggtcatggccgcaagagggtcggtcttgcagacctcctttatcctctccatctcgggagccacggcgttgtacctctcccgaggggtgtggttcttcgtgtattcagggatgcagagcaccacgtcgtatctcccgaacggctccttcctcaggacctcgttacggtagttatccgtgactatgaatccgcccagctcgcacccgcaggcgtcgtcgaaggaacccgtgacggtgaccttcgcctccttcgcacattcgacgccgagtcttatcatatccatgacgtccatggataccccgtgatgtgccagaactgcggatatcaccgcattgcagaccgagctggaactcttgaggcctctggacggggggatctccgactcgatggagaggacgtatcctgcggacggatcgacgcctatggcatccagcgtccttccgacgcagatcctagcaagcctgtcgtcggtactctcggaaccccctatccggacgtcctgggtctttccgccctcatcgtacgaggcccgggtcctcagggcgatacctatgacggccccggtcccgctgacgatgccgttcatgaccgatatgcaaccgtgagactcccctttcccggtcattctatcgcacgcctcatgatctcggtatccggcctcacgccgaaccatctctcgaaagacatcgcaccctgtccgacgagcatgtcccttccgctggccacgatgcatcccgtctcttcggcctttttcaccagcacggtcttcctgttgtagaccatgtccatgacggccatgtcctttttcagaccggccaggtcgaacatgtaatcggaatcgtccttcatgccgacgggagtgcagttgatcagggcgtcgtatccgtccaaggaaatgcccggggcgacctccgcacccatgtccttacaaagggcctccaccttcgccggcgtcctgcccaggacacttactttgcacccggactcctgtgcggcatagaccgccgcccgggaggcccctccggaaccgaagacgaggaccctgtcgcagtcggacagactcctgccggccctttcgaacgcatacagcacaccggcgtagtcggtattggtcccgaccagtcttccgtcctcgttgacgacggtgttcaccgcacccatcctctcggccggtccctcgaccctgtcgaggtaggggaccacgtcctgcttgtagggaatggtcacgttcataccccttatgtcgtactcgcggatgacgtcgtccacatgtgccaggtccggggattcgaacttcaggtagatcccgtttatccccttgtccctcatggcggccccctgcatgacgggggaaagcgtatgtcccagagggttcccggttatgccgaccacggcacagtcgtcccccaaggccttcatctcctccgcactcagctgaccggatgcggtcctcctgcccacgtatccgaaggagaagtcgttgcccaggatcccctgtctgatacgggtcacggtgcccatctcccccatcccgaggacgagatgcttcctcccgacggatgtcgccgccttgtagatggtatgcaggtcggagaacgaccttaccatgcaggcgaatttggaaagctcctggtctcccgtctccaaggtcctcctgaggacctcctcggacggggtcttctcgaaatcgtgtaccgagcggatcttcctgaacggtatctccgcatcggaatccccgacatccaccatcccctcgaaaccggcggggacggcggagatgtccttcccggccagggtgacgatacaatccctgtccaggtcgggaggcaggacgtcgaagacgtccagcctcagttcgtgcatatctgcgtccgccagcctgtcggggacggagccgtaggaggcgcagaccctcatgctcacttctccgtgatggtctcctcgaccttcataccgaagtgccttcccccggtggcgagatgtgccagcaccttgtcgcccttcttcagtttggtgacggactgggaacccttgggggtgacgaccttgatggtctcggcgttctggaggatgacgttgtaggtcttcttgccgtcggtggcctccacgatgagcatgggcctcacctcgaccttgcagcggccgacggaaccgacgcgcgtcttcccgttcctgtcgcatatgaggacggggtccccggcggatacctcggacaggtacctggtcccccctccggggaccatgcagtactcgtggacggccccggcgttaacgcggaagggcctggtggccacgtaaccgttcgcctcgctctcgctctgtatgaggaaaaggcagttggagtaggaaccgacgagcataccctccccgggattcatgaggttgcaggtgtccacacacaccctgtcacccatctcgaggggcttcacggatacgacctcgacctcgtcgagggacacgggctcgctgacggtgaggaggtccctgaacttggagatggaaagcgggtcgtcggtctggatgacgaccccgtccacccccttctccatggtcttcaggtagagttctgcatcctccttcctggtggcgatggcgtacaccttggtcccggaggacctgaacttggcgatcatgttctccagggggatgatggtccagtcgctggtcttcaccacgatgacgtccctcttcccggcgagggcgagagtcttcgcctgatcctcgggggtgtcgatcctgcagacctcccaggacttgtcggtgggcttgccgccgtcgaagaacacggcgtcctccatcttcccgaggtcggtgaactgctcgtcccccttccttaggatgtatgatacgatgccggactcgagaccgttggtgaccaggtccttcctgtcgtccttctcggcggggaggtccgccctgacgaagatcttcttcgcttccatctggatcactgcttcaggaacttggcggcttcctcgacggagtagtcctcgaggacgatcttggagatcgcacgggtgatgccttccacgttcttgttctggaagacgttccttccgatggacacgccgcgccctccggcctcgatggagtcatggaccatgttgaggacgtccatgtccgtgttcatcttgggtcctccggcgatgacgacgggtgcgagggcacctctgacgacgtccctgaaggaatcgatgtccccggtgtagctgaccttgacgatatccgcacccagctcggcggctgccctggcgcagtgggcgaccttctgggggtcgtaggagttgatgtcgtgtcccctggggtacgccatcacgatgaggggcatcccccactcgttgcagatacgggaaacctctccggcggacctgagcatctcgggctcgtactcgtcgccgaagttgatgtggatggagaccgcgtcggcaccgtattttatcgcctcctcgacggtggtgatgtcgaccttgtggttcgcattggaaccgacatcggtggatgcggacaggtgcatgatcagtccgacgtccttcccggaaccgcggtaggagtacctgatcagtcccttgtgcatgatgaccgcggtcgcgcccccgttggtgacgttgtccacggtctccctcatatcgtacagtccggccatagggccgttggagataccgtgatccatggggattatgaccgcgcggccagtcttcctgtccatgatcctctccatgcgaattccttttccatccatattatcgtctccttgtctgtgttgtcagcacggaatatcactgcggtctaaattctgcttatattaagaatttgacgcaggttccgtgttcattgttagcacggctcatgctacgttctaactaataaatattgttgcaattatagatacattagtgaataaaataatacattgtatggaaaaccgcatccgtcgcggaaaaagacccccgcacacccgttacgaatatcgtaactatgccgctccgacagtgtagtacctacatagggacatctgcgttcgcagtaacggattaaaacatgtgccagatattccaatgtcgtatccgggggcgatatcagtaacgacaatcttcgaaatccacagtttcgcgcgcatgcgataaggttttaatcaatatgttcgatagcctgcaacggggaatgggttaagggatggaagagtccgtactgcttgtaaacatgacgatcctcctgcttttaggaggcgtctgctcgatggtcttcaggaaactgaagatgccagcagtcatcggatatcttgtgaccggtatcatcctggccaactattggtccggtaagtccgaggataccgagctcatcgtgaacttcctttccgacctgggactcatattcctcatgttctgtatcgggatggagctcaatctgaagaagctccggaagatgggttcgttcgccataatggtggtcatgatccaggtcccgctgatgcttttcggcgggtatcttctgggtatgctgttcctgggactcgactccctgcaggccatcatcttcggtgccatcatctcgggttcctccaccgccgtcgtcaccatcgtcctgaaggaccaggacaggctcacgcatgccgaggtggagaccgtcatcctcatcacggtcgtcgaggatgtggcacaggtcatcatcctgtccgccatatcgcctatgatgaccggcgaggccatgtccgccgaatccatcgtctggatgctgctgaccatcatcgtgttcatggtggccgccatcggtctgggactgctgttcataccgaaactcctggattggataggcgagaagatgtcggacgagatcatcctgatcgtagccctgggactctgcttctgcatggcatggctttcgaccctcgtcggactgtccatggcgatcggggcgttcatgatgggagtgatagtgtcccaggcgaaaccggccaagatcatagagcacgacatacggccgatgaaggacatattcatgatgatgttcttcatctcgatagggctggagatcagaccggaatccctcgtcgacaacatcgcgatcatactgatcatctacgtgatctacttcgtactgaagtgctcgtccgtcctgctggcatatttcgtcggcaacaagccgatgcgtatgtcgttctactcgtccatatcgctggtcgccatgggggagttcgccttcatcatcagcaaggaggcgtacgacgccaacatcatctcgcccgacttctatgcggcggtggtcggatcggccctcatgacgatgatcctgctgccgataatagacagcaagtcggagaagatctgcgacaccgtccagaacaagagcccccagttcatggtcaacggattcctgaaactcgagaagatgaggtccaacttctacgccaagctgtccctggcctccaagacgaccagggcgaacttccgtaccagggtcacctacacctacttcgaggtcatgctgctggccatcgtcgagatatgcgtctacatcatgacgccgttcctggccgagttcctgtacgacaacacctccgaggccataaccacatattattcgaccatgatcatcatgatcgccaacttcgtggtcctcatcccgatcatctaccgtctggtgttcaacttcaagttcatcgagagggttatgctggattccgaaaggaaggcggccgaggccggttccggaaacatccagagcaggaccgccaagatcatgaagtacctggtcgagatgaacgcgtggatcctcataatcgcgatagacttcctgatcatcctgatcatgccgaacgaggtcagtctgctcgaccacttcgtggtggcaggggcaggtaccctattcgtggccatagcgtataccctgcgctatctgaagagaagatgaagacaccggtacggcccccgtaccggaaatggtctttatggatccgggtcagtccttctttactttcagcctgctgcctttgccatcttcgtactcgactatgacctgacggcctatacggctcttcagctcgtcgacatgcgagattatgccgatcgtcttcgacccgtcggtaatgtctgtaaggacttttatcgcctgtctaagggactccggatccaatgaaccgaacccctcgtcgatgaagaggtcgtcgatcgccctgccgccggcgttgttctgtatgacgtcggaaagacccagggccatggagagggcggccttgaaggactctccgcccgacaatgtactgacgggacgggccttcccggtatcgttatcgaagatatcgatatccagggaatgggatttggatccgtccgagggggatgaactcctgcatagcctgtatcttccgtcgctcatgacatccatacggcgggccgcttcacgcagtatgctttcgagatggaccctctggatatactcctcgaacgacccctgtcccttgagccctttcttagtgccgttggctatggccgccagatcggcgatctcggaatgcctcctctccttccgatcgaaatcttcgaacattccgcggacctccgagaccttctcccgattgatatccagacggtttctgatcgagttgcggagatccatggacctattgtacgcctcctccgcattgttcttccttaccgtcagttccgtcaggtctcccggacgctgtttcccttccacggcacccctggcggtatccacggccgatctggccgagatcagggcatcgttgtagtcgtcaagggccttcttgacggcctcatacctctccttatcacagaaggacctgtactcggcctcgtccgcaaaaccggctttggatatggccgagaagaactcctttccggaagcctcctcctctgcgagatccttctccaaccgggactccaacgtatggagctccgattcggcgccggaaaggtcctccttagccttaccatgttcgctgactgcggattccaggcctctcttcagggagtcggccttattctcggcctcgtccgcacctctggaggcctcctctccagtggagtaacggggatccagtttgaaaccgtctataacggagcgggcgacacttatcctgcccgcacatctgccgatctccacgatgacatcttttagaccgacgttgtacgattccaaggatccacgtatatcgtcgatgcgcgatcttctgtcttcgtactccttggatatcctgcggagttcctcggacctcttcttggcacgttccacatcatccttcgcggacctcagtgcggcgacgatcccgtccatgtcggcccaatcccggaggagtccctccggaagcccttcggccatggtcctgcatttggacatctgggtctgcacagacgtgttctcagagttgtaacgattcagaagcgagtcgcactcggatgccagggcatccctcctcttcctgagggtatcgaccttcttcctgtccgggacctcctcttcggatacggcgaggaccggatgatggaccgaaccgcatacaggacaagggcagccttcctccaaaccggatgcgaggaatgcggcctgtccccggtagaatctgtcctcggtctccctgcactcggcgtccgcggcgttcttctcatccaacttggacgaatatgcggccttggaggattccaggtccccaagcatcgacctgtagacgtcggtctctttcttcagcacttccaaggactccactgtcctttcgagacccgatatgcgggaatccaggatagccagttcggaggatgtgccggcattcgttttgaggaattcctgacatgccgtctcctcctccgccagggccgttatcctcccctccatctcgcttttcctcgattcggccttatccttatcggcggccgcgagttcgagttccttcctggcggaatcgaccttttcgtaattatccaggagattccttgtggatgccgcatcctccctcagggatttctcgtcgccggcggcctctctggccttatcctcggcctcccgggcctctgacaccagtttctcggcctccttcaccctgatacgggaagactccacctcggcggccgtcgccgaggacgccttcgctttatcggaatgtgccagatcgtaagggttcacatcctccaaggccttacggcacctctccgctgtctccgaaaggacgtccatctcctccttcttggatatgagggaatccagccgccctgttgcggaatcgtatacctcgaaactcttcccgagggcctcggcatcggagaactccttcatgacacggttgttctcctccctcttggacgcctcctccgcttcggccttgctcaggagggcctcgtcctcttccaggattcttccgagtatacctatgaccccttctccgtcatagatccacccatcggaggccagcttgtctttcagttcctgtccggccggagactccggcgggaacgacatgctgctcaacctgagaccgatgccgccgcgcacggaatcggtatccgtaccgctggaggaggccatctccttcagcacctcctcgagtttcgagaacctctccgtctcgaatatcgttgcgaggatcctcccgcgttccgccgtatccgctgtgagaagcttcctgaactgcccctgtgccagcattacgacctgacgccattgggagacgtccagcccgattatgtcctttatcgcatcgttcgcatccttcgtcttggtgaccgtcttcccgtccggcagatacaaggtgacggattcggcctgtttgacggtccccgtccctcttttcttggcacggtcgtattccggagacctgcgtaccctgtactccttcccctgatgttcgaacctcaggtcgacataggaatccacggattcttctgcgaagttgctgcggagggtcttctcccctctgtcgtccccgctgacggaaccgtagagggcgaatgttatggcatcgaatatggtggtcttaccggcaccggtcttccccgtgatcaggaacagaccgtccaacccggagaagtccagacatgtcttgcctgcgtatgtctcgaaggcgcacatctcgagtgccagaagcttcattgcatcccctcctccaccctcctgcaggcctctttcaggatctcggtctgggactcggtgagctcgctgttcatcatcagcatatagaatttggagaacagcccctccatgtcgtcggatctgatctcttcgatggagatcgccgtctcgctgtcgaaaagtctgccggcatcgacattgtagtctacatgcatcagattggggatcctcgaggaaagcttctccctggcgttctcggtatcgcccgtgacggtcgcgcacacatagttttctccgaaggaatctgattgtgccagtatctcatccgtcgtccctctgacacatatgaggtccctcagagggacgaggggcacctcctcgatatccacatgccccttctccccgacctccactatggtggccgtcttgggaccttccgactcggaatatttgagcggggatccgcagtaacggacctccggacgccctgcggactggggcccatggatatgacccagcgccacgtagtcgaaatcattcagaaccccgtatgacatgcagtcggcccctccccacgagaatatcgagcaggcctcggaatcgctgcgccgcaggtcgataccgccgccgaccacgaactggtggcacacgaggatgttcctcgcagacgggtccacctcggaggcctccatggtcttggcgaaggcggcctcgggagtcgatatagattcgtcgtccccgtagaagtgcctcaccgaagacgtcttgatgtacggaaggaggaagatgttcagctccccgtattcgtcctcgaccgtatgtttctccgcctttccgcaatagggaccgcagacatggaccccgtccctcatgagggaacggcagcatccgagcttctcggccgggtcgtggttccccgggatcacatagatcgggaattccgacgcctgggtcatgaaccagttgtagaccccgaaggcatcctctcccgcccgggtggagtcgaggacgtcgcccgccaccaagatcgcatcgacgccgtgctcgcgcgctatcccgaggatctcctccaggatgtacttctggtcctctagaagggagaacccgtgcaatgacttacctatgtgcagatcggagatgtgaaggaacttcagaggaaagcctcccgttgacgggggcacatggaagtctgggtatttgtccggtacgatgttatatcggacgatggaagatgtgtaaaagggcgggacggccgtcccgcccatcggagtttcagttgctgtcctcgaaggggtcctgaccggacttcatgtccttgtacaggccgtagagctcgtcggatgatatactcctgtggagtccgacggccgccttcctgaccatctcgagcagggtggcggattcctccttgtcgagggttatgcccctcttggcgaggtcgttcacgagggtgtggcttccggagtgctttccgatgacgatcttcctctcgagacccatgatgtccgggtcgtaaggctcgtagttgtgggcgtccttgatgataccgtccgcatggatgccggcctcgtgtgcgaagcagttgcttccgaggaagggctttccgggagtgatgaccctgccggaagcacaggatacgaattctgcaagggtcttgagcttgaggggctcgatacccgtcttcttgtcgagaagcagctggcacgtcatgacggcctcctcgaggggtgcattaccgctcctctctccgatacccatgacggtggtgctgaggaacctagcacccgcctggattcccgcgatgcagttggcggtggccataccgaagtcgttgtgggtatgcatctccacctccataccggtggcctccttgatcttcctgatcctctcgtagcagttgctgggtatctcccttccgatggtgtcacagtacctgaacctgtccgcaccggcctccttggcggtgttgacgaactggatgaggaagtccatgtcggcacgggatgcgtcctccccgttgcaggagacgtacagtccgtgttccttggcgaactcgacggcctccgtgaccttgtcgaggacccactgcctgtcctttttcagcttgtgctggatgtgtatgtcggaagcggacattgagatggcgacggagtcgacatcgcaatcgatgctggtctcgatgtcatggatgtccgccctgttccatccgaggatggaggcgttgagacccatatgtgcgatgtgcttgaccgcgaccttctcgtcggcccccatggtggggatacccgactcgatctgctggaccccagcatcgtccagaagctgggcgatcctgtatttctctaagttggagaacacgataccggcggtctgctcgccgtccctgagggtcgtgtcacagacgatgacatcgtccttcgacaggagcttcttgacctcgttgtaagatttcatagcatcaacccatgtattgatgttaccttgaccgggcgcccatctcgcctgttgtataacgggagttacctatcctaccattatttttaagcatatcgtaggctggattcccaacggtgtaatgatggacacacaatgtgcgatttcatcacacgatgagtgttttttacatactcggaagaacaacgccatcgcaatctggctattgtatcggcatacggttgaagaaaaaaaagggggccggagccccccgaggtgccgggtctccccggcgtttggatcactcggcgaccttgcggccgacactgatggggtgtccgctgacacccatgacctggacggccgtgaacacggtgcttatggcggcgccggccatgccgatgtacactccgtcggcgaccttgaccgctccgccgaatatgtcccacatgcagaagacggcacaaagtgccagagcagctacggacaggacgagggcggcggccgtgaaggccttggaggagcccctgggcttcaggaagttcaggatctcgaggaccatcacggcaaggccgaagacgagggcgaccgtcggtatgaaggcctggaagtcgccggaatcgccggtcaggagctggtatccgctgaagaggtgggtccagaggaggtccacctgcacccacgatgcgaggaacgaggtgaagagcaggatggcccccacgatggcgaagatccccatgagtttgggctgggggttctcctccttctcgaacatgacaccggtgttcatgttgggatgcttctgggtgttccaccactggatgactatccagcaggggacgtacagaagggtcgcgcagataccgatgatgacgtatccgaatcccatgctgtcgtatacgtagtacagcagccccgggatcatgaagaagaactcgaagatgcacatgaagtaggctccgggcagtgcccatttgggcgccctgtagaccctctcgacatccttgaagcgcggatcgcgcctggatttgatgaacgcaagcatgcacatacccagtgcgatggcgaatcccaacgcggagacggccaggatctgggatgcggtgatgccggcgaggatgattatgaatccgatggcggcctcgaagaacatggcgtacatgggtaccccgtagatgttggtcttggagaacatgtacgggaagttcccgtccttggccatgatctggatcgtcctggcggttccgaggaacgcggtctggatgatcatcaccattccggcgatcaggaggacgacggcgaccgctcctccgatgttcccgaagtcgctctcggcgatcgggatgagggtcgcggcgcctgcggcgttgatgccggagatgccgagggccccgtacatgcagaaggcgatcacgaagtacataaacagacagaggagaccgcaggacatcagtgccttggggacgtccttgctgggctccttgtactccgcaccataggtggcggcggactcccatccgacggcactccactgtgccacggtgaagcatccgaggatcatcaggatcgcgttgccgtcccacttccatcctactgggactacttcgtcggttatgttgttcatgtggaagtccccggtgaagagggggaccatgacgatgatcaggatggggacgatggtgatggcggccaatatcagctgggccttcgcacctccctcgagacctttccttcccgtgattatgatgaatccgtatatgaggaccccgagaaggagatagaacagcgtgttggaggaaccggagaatccgagttcgaaataatcgttgatgtagacaccggtcattatggtgaagatagggatgaccggcacccatgtggcgaaatacgcccaggccccgagggatccgatcatacggccgtaattgaccttcctgcccttgtatttctcatcatccctgaagatatgctggatggatcccccgatacctgccacgccgaaggtggcgcacatctccccgagagggatgttcagaaggaatccggaaaggaccgagagcacccatatggctatgctcatggcccagagattcaccgagagatcgcacagcgaaggtacgatcaggatcgggatccccatggcgataatgagaccctgtttccagtcgatgctcctcacaagggtgtcgttggacaccggagcagcggctgctttgacttcgtcagacattgcatttaccccgtttcttccctttccgcacatgccgacgcggatcgattcacggaatgggaatctggatatgctaagccatttcgtatataaaaatctcgttacgtttgtaaaaatatttaaatacagtaattcaagaatcaaacatatacatagaaattattaaatactatatttcaaaacgtacaatatacaaatgaataattaacatccatttaccaggtcaactgtccattaaaaaacgagattctgcgaagttgaaaagtcagtatataataagaaatgacaaatctctaaaatactgataaaaacggttttgtcagacggcgtagcggaggatcgcaccgacaccgccgagggaggcgagctgtctgcccgcatcgtggtcctcggacaccactatgacgcgccctttctggttctccaccgcacggacgacgtcgtccaaatccttctccctgaggacggagtcgaggaccaggagcgtctccacggcacccgcctccgatgccgaggcaacctccgcgggaccgtaggtcgcgagaccgttcttccctatctgcgtcatgaggttctcgaccgcctccatctccactccgacggacgattccctgaggatcgccgcccccatgccgctcttgatgagttcgttgacccccaccatgccggactgccccgtatgctgcacgtatacgctcccgaaagtccccttgggaaggcgctttatgtcatcggcgagggtctccttctcgaaaccgggacccaggaggaccaggggcatgtccggggtggcgaccgcggacagtttcgatattatctccccatggtaatcgaagggctttcctttctcgtcgtactgcttaccggccctcatggaacgtaccgtgacgacctccttcagaccggactgcctgaggacggccacggtggcctcgtcctgatccagcgagacgaacactatcctgggtttcaccgtgtcccgggcggccgtctccaacctgtccatctgggtctgtttccagtgctccttgccgatacgcagcggctcccccggctctatcatcagggtgtggtgctgcccgatatcctgcggaccctcctctatgactccgaggagacgcatgcggagcccgtcgccgtcgtactcgatcttctcgacacggacgccgagggtcatcctcttcttctcggccctctctgcgcggagcttgtcgtccgccttctcgtcgcggcgggtggtggaggcggtcaccaggtcgccgacgcagatgacgttgtatagatgccagatgtcgtcgtccgtctctgggaggaccttcacctccccggaacttccgtccttgccgagaatgcgcatggtcctctcatatgcaggtctgtttttcaatgttcggtcggaaaaccgtgtccgaaaagcgacggcctgagcgtggaaggagacatcctccgaacgctcccattgttcatatgttgcgatataaaataatagaccggcctggagacggcccgatgtccgtcggaagcgattgtcgaaaaccggggtactcctacgttcaattgcgtatcgtttgtctgcaattggacaaccccgtcgacggcttgtaattagtcgccccacctcattaaataggttttccgtttctgttttttcctcgatggcaagaagttatttagtcctcgaggatgggacggtctacgaaggagagcctttcggataccgttccgacgctttcggagaggtcgttttcgcgaccgggatgtgcggttatcaggagagtcttacggacccgtcctaccaagggcagatcctcgtcatgaccttcccgctcatcggaaactacggaacgaccgatgacttctaccagtccgacaaggtccatgcgagggccgtcgtcgtacgcgaatactgcaaggaaccctccgacatgtatgccggaaagaccatcgacgagttcctgagggacaacaaggtccccgggatatccggcatcgacacgagggacctcgtcatcaagatcaggaacggcggaacgctcaagggcgccgtcaccgaggacagggaatccatacccgacctcgtggagaagctgaaggccgcacccgcgccatccgaggggaacctcgtcggggaggtcagctgcaagaccgtacagaggttcgacgagaacaaggagatcaccgtaggcctcctcgactgcggtgagaagggagggatcctcagggacctccgctcgagatacaatgtcatcatgttcccctacgacacccccgccgacgtcataatcgaaagcaaggtgcagggagtgctcctcagcaacggtccgggagacccctcccaccccatgatactcaaacataccgcgaggaccgtcgccgacctctcctcccagctccccctcttcgggatctgcttcgggaaccaggtcaccgcactcgccctcggcggaaagacatacaagatgaagttcggacaccgcggctgcaaccagcccgtgatgtacgaaggcagagtctacatcaccagccagaaccacggattcgccgtggacgacggctccctggaggggacgggcctcgtcgccgaccagttcaacgtcaacgaccgcacggtcgagggtatgaggcataaggacctccccatattcacatcccagtaccaccccgaggcctcccccggcccgtgggacacctccttcctgttcgataggttcgggaaggtcataaaggagggacacctgtgaggaaagattacaagaagctcatggtcatcggttccggtcccatcgtgatcggacaggccgcggagttcgatttctccggatcccaggcctgcaggtccctccgcgaggagggttacaagacgatcctcgtcaactccaaccccgccaccatacagacggatcccgagaccgccgacaaggtctacatagagcccatgcaggcggacatggtcgccaagatcatcgagaaggaaggagtggacggcatagtatccggtatgggcggacagaccgccctcaacatctgctccgaactggcggagaagggatacctcgagaagtacggggccaagctcgtcggtacgcagcccgaggccatcgcccggtccgaggacagggagctgttcaaggagaccatggaacagatcggcgagcccgttcccaagagcatgcccgccaattccatacaggaggccctcgaggcggtcaaatacatcgggaaataccccgtgctcgtaagacccgcctacaccctcggagggaccggcggaggtatcgcatacaacgaagcggagctcgtggacatctgcgccaggggactggcctacagccgcatccatcaggtcctcatcgaggagagcgtcctcggatggaaggagttcgagtacgaggtcatgagggactccaaggacaactgcatcatcgtctgcaacatggagaacctcgacgcgatgggtatccacaccggggaatccatcgtctgcgccccctgcctcaccctgtccgacgaggaccaccagaggttcaggaccgcctccctcaagatcatccgcgccctcgggatagagggcggatgcaacgtccagttcgccctggaccccgtcaccaaggactaccgcgtcatcgaggtcaacccccgtgtgtcgcgctcgtccgcactggcatccaaagccacgggataccccatcgcgagggtcgccaccaagatcgccgtcggatacaccctcgacgagatacccaacaagatcaccggcaacacctacgccgccttcgaacccaccatcgactacatcgtagtgaagatcccccgctggcccttcgacaagttcaggaccgtcgacaggcacctcggtacccagatgaagtccaccggggagatgatgtccatcggccgcaccttcgaggaggccctcctcaaaggactcaggagtctggagatcggagtggacggcctcgacccggtcgacatgaccgacgaggagatccacgaggagttcaggaacgccacggacaggaggatcttcgccatcggggaggccctcagaagaggatggaaggtggaggacatcgccaaggagacctgctgggacatcttcttcgtcaagaagctcaggaacatcgtcgacatggagaaccgcctcaggaacgaggaactcaccgacgacctgctcaaggccgccaagaacatgggcttcgccgacatgaccatcgcaaggctcgtcaaaaaagaccactgggacatcaggtccatgagggagaaggccggaatcgtccccgtatacaagatggtggacacctgcgccgccgagttcgccgccgagaccccctacttctactccacatacaacggggtgtcctccgaggtacctgcgaacgacgagaagaaacgcgtcgtcctcataggaggaggacccataaggatcggacagggtatcgagttcgactactgctgcgtccacggcgtcatggccctccaggaggaaggcgtcgaggccatcatgatcaacaacaaccccgagaccgtctccaccgactacgacatcagcgacagactgtatttcgagcccctcgagctcgaggatgtcctcaacatcatcaaggaggagaaggcggacggggtcatatgccagtacggaggacagacatccgtcaacctcgccatcgacgtcgagaagggccttaaaggcaccaagaccaaggtcctcgggaccagtcccgaccagatggacgtcgcggaggacaggaagaggttcaccgacctcatgaggaaactcggcatcaaacagcccaagtccgggaccgcctactcctacgaggaggcggagaagatcgccgaggacatcgagtaccccgtcctcgtgaggccttcctacgtcctcggaggaagggggatggagatcgtctactccgctgaagagctcaagacctacatggacaccgccgtaaaggtctccaggaaccaccccgtcctcatcgacaaatacctgaccgaggcgatagagatcgacgtcgactccgtctgcgacggcgaggacgtctacatcggagggatcatggaacacatcgagtacgccggatgccactccggtgacgccaccatggtcctgcctccgttcacactgccccagaaggccatcgacgagatcgtggagatcaacaccaaggtcgccctcagcctcaacatcgtcggtctcatgaacctccagctcgcctacaaggacggggagatatggatgatcgaggccaacccgagggcgtccaggaccgtgcccttcatatccaaggccaccggggtcccgctggccaagatcggcgtcaaggtcatgctcggaaggaaactgaaggaattcggcctcaagggatacagggcgatagaccactacgccatcaaagcgtccgtcttcccgttcctgaaactgccgggcgtcgactccatcctcacacccgagatgaaatccaccggagaggtaatgggtatcgatgcggacttcgacaccgccgcctacaaggcgttcgccgccgccggcaacgaactccccacctccggaggagtgtacttcaccgtcaacgaccacgacaagcctgcggccctcgagatcgccaaggagcttgtgcagatgggattcaagatctatgcgaccaagggtacgtccacctacttcagggagcacggcgtggagaacacggcatgcttcaagaacgacgagaacatgaagcccaacgccatcggcctcatgagggacggggacatcaacctggtcataaacaccccctcccagcactccggtgccgtccgcgacggacacaggatgaggcgtctcgccgtcgaactcgagatacctttcatcaccaccatcaacggcgccaaggtcgccgtcggagcgataaaggtcggccgtaagaacgagatcggcgtcaagagcatgcaggagttccacggactcgtctgaaaccgcagggggcggaagccccctcggaccttacatcccatcggatggatttttcacacactgaaagatatggcggccgaaaaggtcggatcgattcttcaaaacagatggaaaaatattggagaatgaaatcgttttaagggatctggcacatgccatttaccttactaggggcttacgcttcccagggggtatcccattcccagggcttcatgacgcctttatatattgccatcccgaccaccgctgcgacggccccggcctcggacatgaccttggaatcgtcctccgtggtcacaccgccggatacgatgacgtcgtgggggcatgcgtcgatgaatctggtgttggcctccacatccacacccttgccctgaccttcgacatctatgttggtgttgaggacaccggccaatggaagtttggagatctgctcgaataccgatgacagagaggtattgacctcctcctgccagcccttgatggagatcttccctcctttcatatcaagacccagcacaagctttccggggaacttcatcgccatctccgccagccactcgggttccttgacggccttggtaccgacgatcaccctgtctactccggcatccacgtatttccttatctgggtctcggaccttatgccgccgccgacctcgcaagggacgccgcattcctttatgaccttgcagaatgcatcggagttgtcctccttgccgaaggcggcatcgaggtcgacgagatgaaggtacggggcacccagggacacccatttggcggccgtctccgatatgtccggaaggaccacctgctgtgatcctggcactccccccacgagttgcacgaccttgtggtcgaggacatccaccgccgggatcactatcatatcttatcctccgcgaaagcgacgaagttcttcaggaacctggcacctgcatcggaactcttctccggatggaactgcgtcgccaccacgttggcgtcgcgcatcatcgtggggaaggtgaagccttcgtactcggtcctccctttgacgacggaatcgtcggacggggcgcaataataggaatgggcgaagtagaagtgtctatcgtctataccatcgaaaaggggatcctgggtcattacgacgttccaccccatgtgggggacggtgcgggacctgagggcctctacgcggcctttgaagaaccctattccgggagacctgccctcggcacttccttcgaagaggatctgctccccgatgcatatcccgagacaggggacgcctgcccgcaggcggtcccttattccttccctgtacggaagaagtttctctatcgtacagtcgaaggcgccgaccccgggaaacatcatgcattcggcatccagaagcctggacatgtcgctcactacctctacttcggcccctgcgagctcgagagccttcttgatggaatggatgtttcctacgccgtaatcggccatggttatcttcatggttgatcccccgttacctccgagattatgcgtcttaatgaaggggaacagataaaaagacttgccaagggatcggctggccagatgtcccagaccgccgatcatccgacagagggatgccgaggtatacgaagacatatcggcaggatgccgcccttgtgcgtcgggatacatccgcggagatgcacatgatgcatcgcatcatgggtgcatccgacgccgggacggcgacccctcacctcttctcctctgccaggacgtcctctatggcgtcggtcatcctcttgttgagctcctctgtcccgacggtggggcggacgcagttctccgtcctcctcttggaaccgaagtcgcggatgagtatgcctctcttcttcatcccctcgaccagttttgcgtggtcgatcggcgccttggccaggatgaagttggcatcggacggatagggctcgaaacctagggacttcagggatgcggcgagcttcggcctctgctcggagaccatgtccacgctcctcctgatgaacgactggtccttcaccgcggcgatggccgcactctcgctgatcttgttgagggaataggggacctttacggagttcagcatctccgccaccttgaggttggaggccatgtagccgatcctgagggcggccatggcgtaagccttggagaacgtcttggacacgatcaggttgtcgaactcgtcgaccttgtcgatcatcgtccatctggcatattcggagtacgcctcgtcgaggatgactataccctcgtgcctggacaggatctcctcgatatccttctgcctgaagcagttcccggtggggttgttgggcgtaggcattatgaggacgcccctgctgtcctcgcccttaccgaccatggcgtccacatcgagctggaagtcctcggtcagctccacctcgcgcatcttcccggatgcgaggtcggtgaaataggagtaaagagaataggacggatagggctgggtgacggaggtcttaccgggctccacgaacgtggtgaaggccgtgttgagcatctcgtcgctgccgttaccggccacgaaattctccctctgcaggccgtacaggtccgccaaggcatccctgagaccgtccgagtacgtattcggatagctgttggtgtctatagcgatccctttcagataggcctcggcggctggattggaaccgagcacgttgatattcgtatccatcctcagggcgtcccccacggtcggattgtagtacatcgtgagaccctggacactcttcctcatccaatttctgtccatgatatcactccacgagtctctcgatgggcatggtcagtattcccttggccccgatcttcttcagatccgagacgacgcgatagctgtcgtcaccggatatgaccgcctggacggccacccagtcgtcgttaccggcgatgttgaccacggtgggtccgccgataccagggattatcctctccacatccttcagcctgctcttctggacatcggccatgacgtacttcctgccgtcggcgtcgaggacggagcggatggcgtcgacgatctcgccgatcctgtccttcttgtcggggtcgtcgaggaccttctgggtggtgaacacggatgcctcggactcgatgacggtgtcgatctccttgaggcggttcatcctcagcgtactgccggtggccacgaggtccgatatggcgtcggagacccccaactggggcatgatctccgccgccccttggacgaagacgatctctgcggatatccccctgtcctcgaagtacttcctggtgaggtaggggaaggatgtggccacgcggatgccgtcctccatcttcccggtcctcgctatggcggattcctccggagcggcgatggagagcctgcactggccgaacctgaggttcaggacgttcttcagctcctttcctgcctcggcggtgacatcctgcccggtgatcccgaagtccacggccccggaatctatgaagatgggtatgtcctgggcacggacgaagaagacctcgaggtccaggtcggggacctttatgttgagcttccttccccagtcgtcaccaaggttgatgccggccttcgttatgagctcgatggacctctcgttgagcctgcccttgttaggaatggccatttttaccgtcatgttctcactgaaccgcagtataataattaattataaaagcccaaggctggacgcaccccgccgtacatccgttaaagtatattggggaccgggggaggatccccggcccggggatgtctcagagtatgcccttcttataggcgtactcggcgttcagcatggaaccgccggcaccgcccctgagggtgttgtgggagacgacccacatcttgtaataaccgttgctgcacctgatcctgccgacggaggatgccatgccgcgggccctgtcgggcgtccctgcgaagacatcgtagatgggctgggggcggttctcctccgcccttacgatgatgggctgctcgggtgcggacggcagaccgagtttctggggctcccccctgaagtccgcaagcaccttggcgacctcctctatggagggggactccttcatatcgatgacgagggactcggtgtgtccgtcgatgacaggaaccctggcacagttggccatgaccttgaatcccgcatacttgaactccccgtccgcataggtcccgagcatcttggcgagctcggtctccatcttctcctcctcatggctgatgaaggggatgacgttgccgacgatgtcgagggaaggaactccgggatatccggcaccggagatcgcctgataggtggagacgaatacctcgttcagaccgaacgcgtcgttgagggcgcggagcgggacgactatgccggtggaggagcagttggcgttggtgacgatgtacccgccgttgccgtaggtgtcctggtccttgatggagcagaactggtcggtgttgacctccgggacgatgatggggacgtgggggtccatcctgtgggatccggcgttggtgaagacggccacccctttctgggccagctcggtctccgtaggtcccgcgagctcgctgggtatgccggagaaggcgatcctgcaggccttggagatgtggtcgacatccatcttggagatcttcatgtcgagggtctcctgcttgtagttgtagtcgcggaccttcagggtgtccccgaacctcttcccctcggacctctcggatgcgtagagaccctctatctcgaagtaagggtggtcctctagcatctcgacgaacctctgtccgatcataccggtcgcgcccaatacagctaccttgacctttccgctcattatgaaacctctggatacaatgttgggagggattcccgcaacgatcagctcttcccgttgtcgtagatcttcttctgtctctccttggagatgctgaggatgacgtgggcgatctgctccgcctcctcctcagtaaggctgacctcggtgcagagatcgagatacctttcgacgatctccctgcccttggcctcgtcccagtagctctgtccgctgcgcttcttggccttggcgagttcgtcggtgatatcaacgcgggtcgctatgaggtcgatgatctgtccgtcgatctcctcgatctcgtccctaagttctttggtcgatacaggctgatccattatctgcccttccttataaaacgtccaataaggcgcgcttataaattactatctagagaacgatgaaaagatgatgttccgtatcgcccggccaggtgtaatttcagtataaatgcactaaaaaatccataaatgtatcatatattctatgggtggacacatataagcatcattattcttgaaatagagttattaatgaaggcgtatattgcaaaaaaatggaccgcgtacatcaactgttcgaacactatccttctcaagaagcagtagccatgctcatgctgagacagggcataagcgtgaaggacggtaacgcctactgcggtgacataaaacagtcggatgcagcggtggcccgtgcggccaaggtggacaggagggtcgtacgctccaccatagagcggatcgagaacacccccgaactgctggcactttactccaaactcaaatccatgctccttctgtccgaggcatcccccgagatcggatgctcctccatagaggtggtccccaccgatgcgaccatgccgggcatcatggccggcataatggatgtgctctacagggcggggatcaacgtgaggcaggcggtggtcagcgaccccgtcgacgacaaggactcccacctgatcatcgtcacggacggcaccctgccgggaagcgtactttccgccgtcaggtcctgccgcggagtggccagcgtaatcataaaatgacgtctggcacatcgtccggcgattattctgtacccgatacctcccgcgcgcggaaactcgcgcatgtttaattataactagagcgtacgaccgcccattatgacagaacctaggaaggccaggctggaacgcagcacccgcgagaccaaggtatccgtcgagctggacgtcgacgggaccgggaagttcgatgtggactgcgacatccagttcctgaagcacatgacggagacgttcgccagatacgcacagttcgacctcgtcctgaaggcaggaggggacaacgaccaccacgtgatcgaggacaccgccatcgccatgggcgaggcggtcaaaaaagccctcggtgacgctcccgtggagaggaccgcatcctgcatcctgcccatggacgacgccctcgtcatggtcgctctggacctggtcgaccgcccctatgcggacatagactgcccggaccccctgtacacccacttcttcaggagtttcgccatgtccgccggcataaccctgcacatcgtgcagatccgcggattcgacgagcaccacctggtcgaagcctccttcaaggccctgggcaaggcactgtacggcgccacccgccccaggggatctcttctgagcaccaaggacgcagtgaagatggtctgacatgctggcaaagagagtaataccctgtctcgacgtcaaggacggaaaagtcgtcaaaggtaccgagttcgtcaacctgcgcgatatcggctaccctcccgaactggcggagatctacagcaaggaaggtgccgacgagataaccttcctagacatagcagcctccaaggaatccaggggtaccaccctcgacctggtgagggagaccgcacaaagggtcttcgtcccgctcaccgtcggcggagggatccgtacggcagaggacgtccacgccgccctcctggccggtgcggacaaggtgtccatgaactcggccgccgtcaaaaaccccgacctcatatccgagtcggccgagaggttcggaagacagtgcgtcgtcgtagccgtcgacgccaaacgcacgacggccacgaagagcgggtacgaggtcttcgtcaaaggaggctccgagcccacgggcctcgacgcactcgaatgggtggccgaggcggaggacagaggggccggggagatcctgctcacctccatcgacgccgacggaaccaggaagggctacgacatagaactgacgaaggctgtcgtagaccagaccaacgtccccgtcatagcatccggcggatgcggcacggtggacgacatatacagggtcttcgcggagaccgattgcgatgcggccctcgccgcctccatattccattatcgcgagtacacggtggcgcaggtccacgactatctcagggaaagggggatagaggtaagatgacagagatacccaaactcaactacgacgaaaaagggttgatccccgttatcgtccaagactacaggaccaacgaggtcctcatgatggcctactccaacgaggaggccgtgaaactgatgtacgagaccggctacacccacttctggagccgcagcagacagaagatgtggaagaagggagaggaatccgggcacgtccagaagatcaggtccatacaggcggactgcgacgacgacaccctgctggtaagggtggagcagacgggcgtcgcctgccacaccgggaacccgtcgtgcttcttcaagctcatctacgggaacaccgaccagacggcggccatcataccggagctcataaggaccgtcgaggacaggaagaacaacccctccgaagagagctacacctgcaaactgttcggggacgagaccaagatgtgcaagaagatcgtggaggaggcggcggaggtcgccctcgccgtcaaagaccatgacgaggacgagatcgcagccgagacatccgacctcatctaccacaccatcgtagccctcgtcaaggaaggtgtcgacctcggcaagatatacggggagctgacggagagacactcatgagggccgatctgcacacccactccatattcagcgacggggagctcatcccggccgagctcgtaagaagggccatggtcctcggacacgacgtcatagccatcacagaccacgtcgacatgacgaacgtagagttcgtggtgaaggccgtagtgaaggccgtagacctctgcgaggattacatcaaggtcatcccgggggtggagatcacccacgtccccccgaggaagatagccgaggttgcgaaacaggccaggagattcggtgcgaaatgggtcgtcgtccacggcgagaccgtgaccgaaccggtcatgcctgggactaacaaggcttccgtggagaaccccgacatagacatactggcacatccgggtttcatcaccctcgaggaggcgcagaccgccaaggacaacgacgtcatcctggagatcaccggaaggatgggtcacaacataaccaacggtcacgtctacaaaatggcacacgaggtcggagcgaagatggtgatcgactcggacacacacgccccggagaaccttatggacgaggcggccgccctgaccgtggccctcggagcgggactgaccaaggaagaggccgataaagccctccatgtcaccccctacgaggcgacgaaaaacctctgatggggccggacacacctgtccggctcacatcgcttccctgtagatctccgctatctcctctctgccgaagaccttcggattatcctctatccttgccttggacaccctgaacgcattgtcgaccagccagggtatgtcgtcctcgcagaacccctcgtcggaaagatagacgtccagacctatcctccccagaagcatctccacctgtctggcacaatcggtctcgtcgttccctcccagaagtttcgacacgatcgagaacttgggtgcgctgcacatacacgaatgcctgaatatgaccggcgtgagtgcggccagaccgcgcccgtggaccatgtcgcgcagaccgctgagaggatgttccagaccatggggcgctatcagactggatgcgtagaacgccgaccccaccagagacgatgccagggtcacggcgtccaaggcctcctcgtcatagatgtcgtcattcacccttacgatgtacttcgacagtgtggccatacaggtcagactggtaggttcggtcaccggattcgaacggggacttagatacgattccatgctgtggcataacgcatcgaacgtcactgcggaaagtgtctccggcggcatggtctccataagggaagggtcgaccacggaacatctgggtatcaggacgttgtcccttatccccttcttatccttggtgaccgggtcggacaatatggccgtaccgttgcattcgcttcccgtaccgcaggtggtgggtacggcgactatgggaagtgcagtaaggcgtctccctccgaaaccgtccatcatgatcccgtgtatgtcctcccccggattgcaggccatcagtgcgatgcctttggaggcatccatcggacttccgccgccgagtgccaatatgcagtcgcatccggacgacctggccgtttcggccccttcttcgacggtggtcgtcaaaggattcttcgataccttgtcgaagacatggtattccatcccgagagcctccaactgaccttcgaccttttccagcagaccggtcttcgcactgctttttccggtgacgatgagcggtctcctcccatgtctggaaatctcttctccgatatggtcggccttccccctgccgaacttcagatcgaaagggacacaatattcgaaatccatgagaacaccgaaatatcatcctggctcattggtccccatctgtctcgagatccttacggatcttcttgatgacctcgtccatgtaaaggtcgcgtccttcgtcatggaaccggtcgtcctctaccaaaagcatctcgtagagctcctgttcggtcatcagacactccttcttcttaccacctttatcgggatcggacatgatatcaccgtgcaatgccggtccaagataataccgtttacgtcctacgaacgtacgtatcgtcccatgctgccgatcgccggatggaaccatcgttgcaatgtaccagatatggagatcacatgcgtccgcatgtccgttcatgtcttgaaaaacctccgacagccgcatgtgacaccgaacaggcatgatgccgccacgtgtccggaaacgacgtcgccctccggatccatgaggactaaaacgatggtccgggagttataagaccacataagatacgggaaatagattaaaacaagacttccactatccggcagatatgcctaagattgctctcatcggcggttccgggatctacaatcccgacaacttcgaactcatagaggaggtattccccgacaccccgtacggaaagccttccgaccccataatgatcggaaagatcaatggagtggaggtcgccttcctcttcagacacggaaaacagcaccaacaccccccgtcctccgtaccctacagggccaacatgtatgccctctggaaactcggatgcaaatacatcatatccgcctgcgccgtcggctccctccaggaggagtacaggcccggggacctggtcatagccgaccagttcatagattggaccaagaagagggattacacctacttcatggacaagaccgtccacatgtccatgcccgatccctgctgcccctatctgaaccagatcttcgcagagactgcggaggagatgaagatcccctaccacgtcggagggacatacatctgcatagaaggtcccagattctccaacagggccgaaagccgcatgttcaggcagttcggggacatcgtcggcatgaccatggtgccggagtgccagctggccagagaactcggcatgtgctactgcagtctggccaccgttacggattacgactgctggaaggacgaggatgtgaccatcgacatggtcatgaagatcatggcggaatgcctcgacaaggtcctcaggctcctggaactcggactcccgaagatcaaggacgagagcacctgccactgcatcgaatccgccaaagggtgcggttccctcgacgagatccagtgatacaacgacaagatggggcgggcatgccgccccatcggacccctgtgcgttcacacgggggtccataaaaataaagatgggtctgaagacccttttcgatcatctcctcttcaggacgatgaggttggccgcaagacatgacaggactgtgacgactgcgaacctgcacagaccgtcatcattgtgtacttcatgtatcactgtatcctgtaacgtgaaaaacaatgttgggattttgaacagatgagggaatgtgacacaatgccctcggcatacgatggcacaatgatatatcggaaacacaatcagcgttcgtaatgaagatagtcatcagagggaccgtacagggggtgggtttccgccccgccgtataccgcacagcagtatcgctgggtctccgcggtaccgtatgcaacaacggttccaatgtgacaatcgaggtggatgacggcgatgcgttcctggaggccttcctcagggacctgccccctcttgccaggatagagagtgtggaaaagacgccgtccgacatagacccctcgataaaagggttctccatcatcgaatccgatgccggcgacatggaagggtcttccatccctgcggacaccgcggtatgctccagatgcctgggggatatgcgttccgggaggaggaagggatatcctttcacgacctgtaccgactgcggaccccgtttcaccctcctgagatccctgccatacgaccgcggacgcacggccatggattcattccccatgtgccagacctgcggaggggagtatgcggaccccggcgacaggagattccaccaccagacggtgtgctgccctcggtgcggtcccggataccgtcttctggacaaggacggacaggagatccaatgcgacgacccgatagggtctttcgcagagcacctccgcaagggcgatatcgggatagccaagagctggggagggatgcatatctgctgcatactgtcccgtacggcacatctccgcgaatggtaccgccgcccgaacaaaccattcgccgtcatggtccgcgacatcgcatcggcaaagagatactgcgaaccgactcctgaggaggagaggatgctcctctctccgcaccgccccatagtccttgtcaggaagaaggattcggaggtctcggaagcactgtcacccagtctggacaacgtaggggtgttcctcccgtacacggggatgcagcatctcctcttcgaccgcctcggagaggatgccctcataatgacctccgccaacgtaccgggggaacccatgatcctcgacgacagggacatcctcggtctcggagcggacgtgtacctcctccataaccaggagatcgtcaacagggcggatgacagcgtcctccgcgccttcgggaaggaccctttctacatcaggaaatccagaggagccatcccttcgtattacgagttccctgcggaatacgacgcggtggcggtaggcgcccaggagagcctcgcaggggcggtcgcatcccgcggaaggatatatcccacccagcacatcggaaacggggaagggataggggtgccggagtatctggaggaggccgtgaggttccagatgtccctcgtggattgcgaaccccaggtgatcgccgaggacctccaccctgcatatatgaacagacccctggcccgccgtctggccgaggaattcggtgcggaggtcgtggacatacagcatcatcatgcgcatgtggtatccctgatggtcgaccgcggaaacctggaacatctgaccgcgctcgccctggacgggaccggacacggggacgacggtgcggcctggggaggggaggtcatgtcctgcggatatacgggatatgaacgtctggcacatctggagtacataccgctgctgggcggacagaaggcactttcggacatcagaagactcaggttggccatcgacatgttgaacggtgaggagagcgacaccggcttctccgattcggagaccgccgtcctctccaaactggcaggaaggagcatagggacctcgtccctcggaagggtcctcgacgccctctcctactccctaggggtatgcgacagaaggacctacgacggggaaccggccatgaaactggaacctcttctggcgagagggaggctggtggacggattcgagacctacaccgagaacggcatcataaggacggcccacctgttctccgggatcgagaagcgtccggacaaggccgatgccgcatattccgtagtctggaacatattgtcggagatggtggattcggcatcggagagggcggactccgacggtgagggctgcatcggcatcaccggaggggtgtcctacgacgtaccgatcgtcagaatggcgaaggaacttgcggaaaagcacgggaagagactgatctggcacacccgtgtgcctaacggcgacggcggcatatccacaggacaggtcgcggcggcgctgagaagaccgtgacccatccgaccgacgagatatgaccggtatccagacggttccataaattggatgcatactccaaccgtaagactgtttatctatccgagggataatacttccatccatcacagaagacgctctcgccagcgttctggaacagaggaattcgatgaagaacactttgttcgtgctgctcgacggaatggaagacgaccccaatcctgagctgggcggcaagaaaccatacgaagtcgccaagatgccttttatcagacgtaaggcaccccatttgcactggaccaccggaaggggatatacccagctcttcctgaacgagttctggaccgggcaccctcccgacatagcgagggcggcgatagaagcctgcgggctcggaatggacatgtcccacaaccgcatggccttccgcatgagccccgcgttcatagacggaaagaccgtacattgggcatacggcgtggacgacagggccgaagacctcgtggagagcgtgaaaagcaacttctacctcttggaagacaggaacccccagatagagttcttcgtccatggaaggtcggtcatcacgatggaatgggacggagagccccagcagaccccccaggcacccgtcgacgggccctatgtacccatagaggaccctctgggggaactcatactgaaggtagcatcggagaacgacggactcaccatctatccgtggggcataggaagggtggggaaggtctatcccccgttccctgcggttaagaacatgacggccatctcggacagccccaccgcattgggtatcgccgccaccctgggccacaggatacagctcatcccggacctggacgaccgcttcccggcggcccgcagggcccttagggacggacatgtgttcctgcacatggacgaggtcgacgaatacagccatgagaaggacgcacataagaagatcagggtcctggagcacatcgactccatgatggaggaatacttctcggacatcgagaacgtcgtgttcttcgtagaccacgggacctcgtgcgtcacaggcacccatatcctgatggacgtaccgttcaggacagacatagaatgtttcaaggagggggagcatgtcgaactcgacagactcgtccccgcacttatggagaaattacaatgactttcgaacttccgccatccctcggaatacacggggacagaaagaccgcagaagacatcatgtcccgcatatgggggaagaggggcgtcttcacctgcacgatagccaacaccctgacctccaccatccccggcatatctgaggcgggcgacaccccggaactgaccttgttcaccgggcctgcggatgctgagttcctggtaatgggcaaggtcacttgcatgaaaggcatcccgataaaccccgggaacatacccacccccgcgaccttgaccaaagcggccctggaactctccaagatgccgttcctgatcatcaacggaggatcccaggtaatccccaacatcccctgcatcgaggtaggcggggaatgcggacagaagataaccaccggccacgccatgagcgctgcccaggtgaggaagagcttcgaatacgggaggatactcggggaacagctcgcgaagacgtacgactatgtcgtcatcagcgagagctgcgccggagggaccactaccgctctcgcagtccttctggccatgggcaccgtgagggagaacctcgtaagcagctcctcccccaagaatcccaagcaattcaagtgggacaccgtcatgcagggactcaacgccgccgggatcgggataggagaccttgcggacgaccccctgaaggccgtggaatgcgtcggagacccgatgatgcccgtcaacatagggatactcgtcggagcggccaaacatgtgcctgtgatcgtcggcggaggaacgcagatggcccccataatggcggccgccgtgaaactcgaaccgtccataataggcaacttcatgcagggcaccaccagatggctcctctcagaccccaattccagcatggagaggcttgcagaggccatatccccgtccatccccatcgtcaacataaacatggattactccaagagcccgtacgagggtctgcaggcctacgaatggggatatatcaaggaaggagtgggatgcggaggatcgtccgtggcggccgtcatcgaaagctccggaaggatagactgcgacatgcttctcgacaaggtccatgagatctatcagaagatcatgaacgccgattgagcttttcaaaaggggggcttcggtgacgaagtcccccgatattcctaaaatatggatgactgttccatccatcctatatatacttcataaaggggtatataatcagtaatacgaatcttctagaaagtagcaaaaatattattcccgaaatgaataaaaaatctaacaaaaagaagaggtgtcaatagtcctcttcgacctcgacgggacagtagtgctcgtcgaggagatcgagctcatgggagatgcgctcgttcctgcaacgggaacattcgacctccttgtgaagcttcttcttgagttcgcagccggaacgatcgaaatccacaatcctcccgcatctgcagtaaattttctggaaagaggaggggccagcatcgtaaatcagactgtttcttacgcaatctaacggcatgaatggatcaggcgctacgatgtccgacaactaaactatcccccagttctttgaaacgccgaagaagtatccacgtcctatcccgattcttccaaggcggacttccccatcctgtccttagcatataagcattgtgcaggaccccttataagccgttccgagatggccggaacaagacgtatcaatgctaaaaaatgaacagaaatatttaaatataagataataggccgtttttcgggtatttcgccggaaaacggccggcgggaacgacgtcccgcttcagagcctgagggccttcttaccggggaagacggccttgctgccgagcctgtcctctatcctcaggagacggttgtacttggcggtcctctcccctctgcagggtgcacccgtcttgatctgtccggtaccccatccgacgcataggtcggcgatagtggtgtcctccgactcaccggacctgtgggatacgacgacgttgtatccgttgtcggcggacatctcgcaggcatcctgggcctcggagacggtcccgatctgattgaccttcagaaggagggcgttggcggcacctttctttataccgtccgcaagacgcttggagttcgtgacgaacaggtcgtctccgacgatctgaaccctgttcccgacggccttggtgagttccgcggtggtggcatagtcgttctcctcgaacggatcctctatgcttatcagagggaactcgtcgatgatggacctgtagtggtccacgagctctccggcggacagggacagaccgtctacgctgtactttccgttctcgaagaattcggaggatgccgcatctatgccgagatagatatccttgccgggctcgtatccggcatccgaaatggcctccactatggtcccgagagcctcggagaccgtgttcaccggaggagcgaatccgccctcgtccccgacattgatggcaccgaccccgtatttggacttcaatatgctcttgagggaagaataggtctccgcggccatcctgaggcactcggagaagctggaagcccctgcgggtatgatcatgcactcctggaccttcagatcgcctccggcgtgcttgcccccgttgatgatgttgaacatggggacgggcagggtgacgtggtccttcccgatgtactcgtaaagctgctggttgctgacgaacgcccccgcattcgccactgcgaaagatacggccgtggtcgcgttcccgccgatggacttcttgttgtcggtgccgtcagcctccaccatggccatgtctatggccctctgatccgtgggatccatgcccactatcgccttggccacggtcgtgcggacgttctctacggccttctggacacctttgcccttgtacctgtctcctccgtcacggagctcgtgggcctcgtacatcccggtagaggccccggacggtgcgatggccgagatctcgtgaccgttgacggtcacgacggcctccacagtggggttgcccctggaatcaagtacctctcttgcccaaaccttctcgatctttgccaaaaatcattcctccttgtataatgtcatcatactggtgaggaccgccctctcgttcttcttgaggacctccccgtccacggatgccagaaatgtgaatttgtgtttctcgcctctgagcgccaggatctccttgagcgccacgaacgtcctgtccatgccgcaatggtcgatgatattgtccaggtcgtccaatgcgaccaccgggtatctggaaccctctatgaatcccctgaccatgtcgatcatcgtacccagcggatagaagttccctttgagggtgtagacctcggcccccttgtcgagaccgaacctctctctggcgaccttcgccctggaggcggttatcagaagcatgtcgtacccggccatcgagaacgtctgcatgatatccaggacggtacggggattctcttggaagaatacgtacgactccccgtaggttatccccctcctgaccagctcgtcgttgggattggccatcattctgccgcggtccgcatccactatgcgcttgtccttgggaagggcggcgttgatcgcatcgaccaacatggatgtggtgaatggcttcacaagttcggccttcacgaagatgcagctttccggtacggattcggtgctgttccttatgacgatgatggcgggaccgttctcggccctctgtctgcgccctttcttgctctcgggctcggcctcccaactctccagatcgtctatgaaagacattccggtgccgtcggagacggcggtatcgaggatgacgatacgatgatccttatccgtctggatggtggccatcgcctcttcgacggtgttcacggccgtatgttcgatgccgttcttctcgaggacatccatgagcatggtcttcatgccttccctgtcctcgattatcagagccttcatctggaacctcctggtcgcttccccattttggttaaaatatattaaaggtgggaagacggatggatgacgatctgacgaccgacaaagtcaaaactaaaagataccgatttacagtatcgaaacgatttcgaagtacccaacgggccagggatggatgatccccggccacgtcggatgagaccgcgaagcggtgcagaaagcttactgcttcctgctctcttttgccttcggcctcaggttgctgtatccgcatttgcggcacttggtcgccttgagcgggttcgtcgcatagcagttcatgcagacggacttgtcaaggagcctgtgctcagcctctttgaaacgggccatttgttattcctctggcagaccaataggcaagcaatataaaacccttacccaatcaatctcctctatcctctttcttcttacgagggttcctgaagactgtggtgtcggccacatctatggccgtacgacctttcatgatgaaagtagccaggatgaccattatgacgcttcccacgaggtccgccctcagatcgtccaacgtatcgaagtccccgtagaccatcacgctctgacccaccaggacgtcgacgtatccctccatgacctcccatatccctccgaaggcaagggagatcatcagggtgtagcaatggatggccgcattggaacccagcgtgacatgggcgggggaatgcttctctatgagacacagtgccagaaacactatcgcaccgacgctcatggacgacagcacatgcccgaagaagccccaccacgggatgtccgggtccatatagaacccgaggcacagggagatcgtgtagatgtacacgtcggccatcagcaggaaattgaaccaccagggcatcttgaccgcatccaccagcctgaggaccgggatgacgcacgatatcagcgcgaaggcgatgcaggtggcctccagataccatgcgggatgccatctgagaccgcgggcaatatccgccgccaccgtccagaacattatggcgaagatgatctcctctatgatccagacggcgatggtgaacttcctgtccccctcctcggtcatgtggatcattccgacacctccagatattcgcgggaaagcacgaacttcttccccttcatgtaacgcacgatgacgacggccgccaccagggacaggacgagcccggtgaacaggtatgcgagctcgtctacgaagaagaacgtctctccgagctggtccttgttgaacagggatatggccaccagcatgagggatgtgaacgcctcgctgttgaacacgaggaaccctccgatgaggaacctgttgagtctggatccgaacaagaccgctatccccatggtggccacatatgccagggggtaggatatgcaccatgtcgccacaccttcgatgtgggcgtagatcttcttatccgtactgaatacgccctccaggttcccgtccgcatccaccacgtatgaactgtagatatcccctgtgaagttcaggacataaaggagtacgaacgacatgaccatcattacaacggccgacaggagcggggcccggggatccaccagtctgtccctgctgcagtacaggaggaccgcatacagcaccaaggctatcgccgcatacatcgtgacaacggtatcgtcctcataaagacccagcgcgatgaggaataccgctatcgcgatggaaatgtagtatgcagcgatctttttcattaacggggggcatcgacaacgtacttaaaaaactaagtaggaggagccctcactccggtgccctcgccttcctgcggaagagcttcccgcggtcgttctctataagcctcatcgtaagacccagatagagcaccaccatcattatgttcctcatcaggaggatcaatatccccaatgccgacatggcctcgccttcccctctgaagccgaaattcacgaggaagtccaactgtgtcagcacctcccctatgacgaacagcttcatcatggtgtccttctcctccctcttccccgggatcacatacagaagaaggacgaaaggtatgagccagaccatatactgtccggagaacacggtggataccagtatgaatgtcatcatggcgatggtcaggacgagacacgtatctggccgcagcttgctcttatccagaccgcttctcaaggtccaatacgcataatgtgcatacagaaggaccaggacgaccgccatcaggggaagcatcagaccggagaagatatccggcagggatccgtatatgttgtccgacccgaaatcgaacccatacgatacgtctgtaagacccagcagagccgtgaactcgatcagggaggcgatgaccgactccatctccagcgggcggtcggtatggtacttggtgaaggaaagagggtccgcaccgcacagatagaacagtgccagcaccgcaaggcctgtgatgatgaaggcggccacccccttcagggcccccatcctctcgcccttggccaacatgtatatcgcgaggatcgggaagaatatcgcaggatacagcttcacggtggtggcgaatgccaacaccacgaaggcccacgtatacttcctatccatcgccaatatcagtgccaggaacgtcaggatcatggggatcatgtcgaacctgtccgtcaggaactcgaacatcaggaacatcaggaccgagtagagtgccattatcctgagacggtcgtgacccatcctgtccgccagacgttcgctgcaccacagacccaggatgaagaacagaccggtcatgactatgaatgcgacctgatatccggccacggatggcgcgaacatcctgggtatgaaaaggaacaggtatgccatgggcggatattcccatgtacgccactcgtcatatgcccagacctcttccgtatacgggaatatgccgttcgccatggcatccgcatagggaaaatagccgtcgcatacgctggaaggtatatccgtaaggtacacgactgcgaacaggatcgcactcaggaccgcatatatgcctatgaacaggatgtagttcctctgtcttccggtgatgttgacgtccaatcccatagccccctgatcaatagactcacggcagcaacgccctctgctgacggaggtccccgtacttgtcgtcggatatgaatcccatcagctcgtgggtcaaatagtctggcatgatggcatccacgatctcgttcaccctcctgcttgaatatgggcggtgctggtctatacccttcgccctttcgaaggcgtcatgggcgaagtgctcccactcctcgccttcggcccttctgcggggaacgaacgtcctcctgtactcggcggtggtgctgagctggagatgcatatgccttatcctgtccttcatatccttcggataacggtcgattatgctcatgaccgcatctatggcgctttcctcgtcgaatgcatcgtcacatgtattcatcatatgaccggtgtcgagggtgaatccccagttgtcgaactccagcttgtcttccaggaccctccattccgaaggactcctcagtttgaggccctcccaccagaggttctcgaaagaaagacggaacggcggctcccctccgggatatcccgccacgacacggttcaccatctcggcgaaatcggagattatcgcgagatcgtcgctctcgtgtttcctgcagaggacctgacgcatgtcggtgttcccggcatgcagcaccccgtaggccggatggaggactgacgcgcagtcgatcccatggcggagattggccaccatgtcttccctcgtccttccgaacgagaaatacctcgggtcgtcgttctccccgtcgtacctgcgtccctcccatgccgaatgccaatccaaggaatagggcagatggacggataccacctccggtactgcgtagtacggatcgactttctcgaacagggtgaaaagttcgaatccgtcgagcccgaaggccgacagcctgtgccggaggtctccttccccggggaaatcggagaacctgtcgaagacggaccagctgaacaggtgcttcatcacaccagctcgaaggccgcattgaggacggcctcgacggcggcgatcttgctgctgccgccgcctacgatgattacgtcgtcggcggttatgccggtgtccttgcggatcttatatgccagttcgggagtctgctcgtccatgttccagtcgggcgggatcatgagtttcccgtcgcggatgacgatggtggtgcagccttccgcaccggccttgatgccggcgtcgcgctgctgcatcccgttgactatcttcgaggaggcaccatagactatgactccctgtgtgaaatcccccacgacggacccctggaggtccacgtcgatcagccttaccgggatctggtccaggaaaacgagcccggccttcgttatggatatcccggtctgtttgatctggacgaagttccattccctgaacttgtccagaatgcgacgcatgcttccttcgccgacaccggcctcctctgcgagcttcttccttccgatacgtttcccgtcagagaggacgtacaatgcgtagtagacgttcgcgtcggtgaaacggaacattggcccgaaggccggtatatccattatcttcatgttgtttgactcccacacggacgtccggagacggccgtgtggggaggccggactcagaacgtcctgatcttaccgttgatgataagttctgaaaccttatcaatgttgtctaaccaatcagcggcgatctcgtacgcctcgtccttccacttgttaagcttggggctgtcggcggcgttctcgttgatgatgtcgatgttggcgttcagcgggtcggagatggtgtgtccgatctgggacagcaggcgcacgtggatctcggcatccgccttgaccttcttggccacgtccttcgcgatcatggtggagaggacgttgtagatctttccgacatgggtaatcgggttctttccggaggtggcctccatggacatgggcctgaagggggtgatcagaccgttgcacctgtttccgcgtccgacggaaccgtcgtctcccatctcctgggagagtccggtaacggtgaggtagtacactcccctctcgtaatcgtctccggtgttgacatcaacgacgaggttctccccgtcaccgtatttgtcgatgatccccgctccgaaatcctggacggatttggtgaggtcctcgaccgcactcttgtacgaggtggggtcgtcgatgaacctgtcgaccatggcgcaggcgatggtcatggttatgtccttgccgaccctgctgcacatgaccttgacgtcctgtccggcctcggggatcttcttcttgagcgccccgttgatgtacctctcggtctggaaggtcagctcgtcggtgacggagaagggcgcgaagccaactccaaaggaggtgtcgttggacaggtagttggaggccttgtagacgccggtgaggtcgtcggaacccattccgagcttggtgtcgaggatgacgtcggaatcgatgtcgaggtaggggtaggtcttcttcagatacttcctgacgcctttgagggcggtggactcgacggggagcgatacctccttgccgtccttctcgatgtatgtggtggcacggccgtccatgagaatgtagacgggcttgacgatctctcctccgccgaacttgggggcggagataccggccacgacctcggtctggtcggtgttgtggtggagaacgtgtccgacctctttgatgtacatcgcgcagagggactcgctgacggtctcggcgacaccgtccgcgacggagtcgggatgtccgattcctttcctctcgacgatctcgatctgcctcttgggtacagggacctggttgatcccgttgacatagatgttcttctttccggacatagtgcatcactttgagcgatatgctgctgttcagaaagatatgtttaaggtttataatattggttgacggaagtattctaataagaataagtagatgcgctcagacatgaaattcccaccggcatccgacatccgcagaatgaggaaggcgatggatgtgacccagacggaactggcgaagcagtccggggtcagccagagcaccatagcgaagatcgagagaggaaggatctccgcaagttacgacaccgtggtgaaactcttcgagaccctggacgagatggccaagggagggaaacacgacgtcaccgccgccgatgtggcatcgaaggacatagtgagcgttcagagcaccgacagggtccgcgtggcatcggagctcatgaggaccgccggattctcgcagctgcccgtccttaagggggatacccccgtgggcagcatctccgagaggagcatattcgagaagataaggtcggggaagaccatggacgacatcaaggatgcaccgatatccaccatcatggacgactccttccccgtggtgaacgagagcacccccatgtcgtccgtcacggccatgatgagcgactgcaatgcggtcctcgtggccaggaaggggaaacttgtcggaatgatcacgaaggccgacatcctcaaactgatctgacgccggaaccggtcacacgatagcgttccatgtcgaagggcgcataggtcctggggaatacggccctggcctccccgaggaccttctccggctccttgtagcggttgctgatatggaccagcatgagcgtcccgcatccggcgtctctggccagcgaggccgcctgcacggcggtgctgtggaaatgctcctcggcgagcgacgactcctgctccatgtatgtagattcatggatgagtacgtctaccccctccaccgcatctctgacactctggcacatcctcgtatctcccgtataggcgaccgagatcccctttttcgcaggatccgatatgtctccgagcctcaccccgttcacctctccgccgtcctcgatcacggagaaatccttgccttctatgcccagggatgcggccttcttcgcatctatcctcccgcggacgtccggctccctcaggacgtacccctgggaggttatcccgtgctccgtggcgaacacggagacagtcatgtctttcacggcgaccacatcgccgggggacacgtcccttgattccagatcgtactccagatccccctcgcagatatccagacaggtcctgagcgcctcggagaatccctgaggaccacatactatgagggggtcgcgcctgcccatcatgcccatggtctggagaagacctggcagtccgtagaaatggtctccgtggagatgggtcacgaatatcgccctgatcttcatgaatgagaagggggagatcatgagctgacgctgggaaccctctccgcaatcgaaaagtactatatcgggccccctgcggaccgcgacgcagggaagggccctgtccttggaagggacgctggcgcccgttccgaggaaaagaatgtccaacatctcagtagatggagtcgatggacctgtcggtcttcgtttccttcttgtactgtttgtaatgctctttgcacagatggacgttgcgggcatccatgttcttgagcctcaaggtgcattttgcaacctgtttcatgttgagtgacctttcggcctcgcaactgcaaccttctacgtcgcagatatcggtcttggccccgtggcctgctgttcctgacatgatcacccctatcgatgtgcgactattaataatttcgacggtgaaaacaatgacccagatgatcaaatagcgttggcatccgaacgttctgacgcatacatgaacgccctcccttcctcggtcagggagtatatcctccatctccgccagggcccgtgtttgaccaatccggccccttcaagaatatccagatggtaggatatcctggattcggacatcccggtcaataccttaatggcggaggggcacaggtccgcaccggcaagtatgtacatgatcctcagacggacggaagaagaaagggccgcgaatatctggcacttctcggtcagaacgtcctccgacggaagaccccggacgatcttatcgatccctccggcacgctccaccatccctccgacctcatccggtacctcgggaataccatcgaatgtctctgaaccgcacatgttctccgacatatggcaaggaattgatttcaaaaatatttgaaatgaatcctttccaatccaaattctttattacgataggtatatacgacgtgcaatgacgaaaatcgccccctccatgctgtcttgtgatttctccagattaggcgaagaactcgtaagggtagaaaagagcggagccgactgggcacatctggacgtcatggacggcatgttcgtccccaaccttacattcggagcacctatcatcaaatgtgccagacactggacggacatcccattcgacgcccatctgatgatcgaggaccccgtcagatacgtagaggatttcgccaaggccggatgcgactccatcaccgtccacacggaggccgagggagatataatggccgcggtggacaagatacacgacctgggactgaaggccggcatcaccatgaaccccccgacggacgtacatgacctcgacagatatctggatagggtcgacctcgtcctcataatgaccgtcaacgcgggtttcggcggacagaagttccacgaggaatgcattcccaaaatagaatatgtgaaaaaatgggccgaggaccacaacccgggattggagatatcggtggacggcggcataaaccgcgagacggggaagaggtgcgtagaggcgggagcgaacgtcctcgtagccggatcggccctcttcaaactggacgacatgtcccaggagatctccctctggaagggctacggaccggatgcggagagatgagatgggagtcaacctttcggatctgaccgagccgaagagcatggagatggaggaccttcgcgggaagaaggtggccatcgacacgtacaacatagtgtaccaattcatgtcggccatccgccaacccgacgggtatcccctctgcgacagcaaagggaggaccacctcccacctgacgggactcctgcaccgcaccgccagcctgatagaggccggcatagagcccgtattcgtattcgacggaaaaccccaccccctcaaacaggccactctggacggcaggaaggaacgcagggagaaggccgaacaggagtggaaggacgccgtggaaaggggcgacatgaagacggcccacaccaaggcacagcagacctccaggatgaccgacgaggtcaaggagtcggccaaggaactcatcagatatatggggctgcccatagtggatgccccctcggacggggaacaggaggcggcatacatctgccgcaggaatgacgtatgggcgaccgcctcgcaggatttcgactcccttcttttcgggacccccgtcctcctccggaacctcaccatgacaggaaggaggaagatccccggcaaggacatctaccgcgagatcaaaacggaggtcatcgattccgaggaattcctccggaacctcgggatatcgagggagcagttagtggacatgtgcatcctcatgggcacggacttcaataccggcatcaagggcataggtcccaagaaggctctgaagctcgtgagggacaatggggacctggaatccgtactgcggaagatcggggaggacatcccggactaccaggagataagagggatcttcctggattacgaaggctccgacgactattccgtggagcacgggcccttggacagacaggcggtcgtcgatatgctgacatcctacgatttctccgcggacagggtgaactcggccctcgacaggatcgaaagtgccagaaaagaggaggaacggaagcgcaagcagaaggccctcgacgcatggttctgatgttccgtcctcaaaagactgataattacctatataacgatggagcggatgggtcgtccaagagcgggacaagatagctcctgctcagaaggacgagcgatgataaagcaaatccagggaaattattccgcccccaaggtggagaaggaggtccaggaagaatgggcctcggagcatgcttacgaaaagaccaaacagctgagggagaacggtcccagattctatttcctcgatggaccgccctacaccaccggttccatccatctgggaaccgccatgaacaagacggtgaaggatatcctcatcagatactggaggatgaacggatacaacgtccgcgaccagcccggtttcgatatgcacggtctgcccatcgaggtacaggtcgagaagaagatcggcgtccactcgaagaagcagatcgaggaggagatcgggatagacaacttcgtgaagacatgccaggacttcgccaagggactccatgccagcatgaccgacgcattcaagcagctcggcgtatggatggactgggaccacccctatcagacgctcaaattggattacatggaatccgcatggtggaccgccaagagggcgtacgagcgcggactgctcaaggactccagcagggtggtcacctggtgtcccagatgcgagaccgccctcgccgaggccgagatcgactactgggacgagaccgacccctccgtcatggtcagattccccctgaaggacgagaaggacgtatccctcctcatatggaccaccaccccttggaccctgccctccaacatggccgtcgccgtccacccggacgagacgtatgcgaaggtcaggatgtccggagagaagggatccgaggacgtcatagtcatgaagtcccaggcggagttcgtgatgcagaagggaggatacgacagcttcgagatcctcgaggaaaaggtcggaaaggacctcgtcggcaccgcatacatcccgccgttcgagatcggagacggtctcaagaggaccgaatacacctacaaagtcgtcgatgcggcctatgtcgagaaggacaacaccggtctcgtccacaccgcccccggattcggaccggacgacttcgagaccggtaagaggtacggtctggtgccgttctgccccgtcgacgagtccggaagattcaccggggacttcccgatgatggccggtaagaaggtcaagacgatcaacgaggatatcataaagcacctggaggagaacggtctcctttacaacacatccaaggtaaagcacaggtacggacactgctggagatgcaagacccccatcatctacaggaacacccgccagtggttcatagacgtccccaaggtcaaggacaccatgctgaaggaggtcgaccgcgtcaaatggacccccgattgggcaggtgccgccagggagaagaactgggtcgacggggcacgcgactggtgcgtatcgaggcagaggtactgggggatcccgctccccgtctgggagtgcgaatgcggcgagaagaaggtggtcggacagtactccgaactcgaagagggggagggatacacgaagggcatggatacccacaggccgtggatcgacaaggtcaccttcaaatgccccaaatgcggcaaggatatgcacaggattcccgatgtcatggacgtctggttcgattccggcgtggccgcatgggcggacctcggatatcctgccaagaaggacgagttcgagaaatggtggcctccgaagttcatagtcgaggcccaggaccagacgagaggatggttctacacccagctggcgtccggtgtggtctcgttcgacagagccccttacgacgaggtcatgatgcacgggtggatgctcgactccaagggaaggaagatgtccaaatccctcggcaacgtcgtcacccccgaagaggtcatcgcggaatacggtgccgacgccctcagatactacatgataatggtgaacgccccctgggaggacaccgctttccagaagaccggtcccaaggacgcatggaaagtcctcaacaccctctggaacgtcgtcaacttcgccgcgatgtacatgtccctcgacaaatacgaaccgtcggagcacaccctcgaatccgtgaaggcggatatgagggacgaggacctctggatgctgtccaggacggagaagatgaagaaggccgtcaccgacgggatcgagagcagggaactccagaaggtcgcccgcgccctgaccgactacatcatggaggacctctcccgctggtacctgcacctcatcagggacaggagctgggacgaggagtccacggccgacaagacggcctcctattacatgttgcacagggcgatcatgagcaccgcggtggccctcgcacccatctgtccgcacatctcggaaaaagtctacagggccatggacggggagaaactctccgtacacatggaggactggcagaaagccgacatgtctctcgtaaacgaggatctcgagcacagcatgcacctgatccagaacatcatcgagatcgtcgccaccgagaggggaaagatgggcagcaagctcagatggccgctcaaggcgatctacatccgcgggaaggatgccaaggtcaacgccgcggtgaaggtattcgacgaggtgctggcacagcagggtaacatcaaatcggtcgattatctgcccgagggcggggaggtcatcggcaaggacgacgtggaacccgtccccttcgacgagggagagatcttcatcgatttcgagatcacccccgagatcgaggccgaaggttacgccagagaactcatcagaaggatccagcagatgaggaaggacatgaagctgaatgtggacgaatacatcaacgtcgacgtcaaggccgaaccccacctcgtggaccttttcaagacctggcaggaccatatctccgcagaggtccgcgccaaacagatcgagtacaccgacgaaccggccggagattccgtgaaagactgggacatcaccggcaagaacatcaccatcggtgtgacctcgtccaagatctgacggggatgcggccggggaaacccggccgtcccctaaatatcttactcttttccaagaatgtacattatggcctcgttggccagggtcattccgaatatggcaggtatcgtcggcatcgagcccaggatgctcttcccgttctcatccttctccgtagggacggccaccggcctctccaaagaatatacgcatgttatgagcgaggtgtcgcagcccctgagctccctgcggaccctcgccgccaccgggcataccgacgaatccatgacgggggcgatacgcacggccattgggtcggtatgcagcgccgcacccatggaagagaacgcccttatgcgtctggcacatgcttcgcggagcagacggaccttcatccctatcgtatctatggcatccacgaggacgtcgggacccatgtcgagtatggcaggtatggtatcctccgatacgaggacgtccatggactcgatatctatgacgggatttatgcttctggcacgttcgcaggcgacctccgccttaggccttccgaccgtcgcagtcgtggcgaggatctgacggttcatattgctctcggagaacacatccttgtcgaccacacgtatgtggcccaccccggccctgaccagaccttccagcgcatatccgcccactgccccgcagccgcataatacgaccttggcgtcacggagacggcggaccccgtcatcacctatgatcagcctggtcctctcgttcatacctgcactcatccgaccgtcctctccagattctcataagtattccgggccaaatcatgcggcggacaccccttcacatcggccatggacctcacgaagtcccccatacccgtaaaaaaccttccctgatggggagcgtccgattccaggagaagacggtcgtccgggatgagatccagaagacggcggaccttgtccttcgaacgtgccagtatgcgcggagacagggagaacatgcatcccaggtccaaaaacggcttcacatagctctcggacgagaacgaatgcagtattatccctctgcacgatctgccatgggtgcgtatggcatccaggacctgcttctccgctcccaccatgtgtatgctgacgaccctgtccatcgacgacgccgcatccaactgtcccgtgaaggacggcatctgctccgagacgtcccccttcttcgaatcgagtccgatctcccctatctgacaggatgaagacttctccaggatcgataggaaacgctcctccacggaaacgttccagcacccgcagttccacggatgtatccctatggaggggaccacggtccgggaggaaaaggaaagttggaggtcccattcgccgggatctgccgtacatgataccgcccgggtaagcgagtcgaagtccccgtagtttccgggaaaccccgtctcgcacatgtggagatgcgagtctgtaagaaaacggatatccgccattgcgacctcgggagggacggaccccggagggccgtccccgtcagaagttcttgactatcctctcgacaccgtccacgagtccgtcgcaggagacctttccgcggtcgacccaaacaaaatcggtgttctcggaattcaactccaccttgtcggaggacaccttgtataggaaaggatggacgttccatacgacatccccctccctcacatagaagtgggtctgggatgcgtcggggaatccgaccttgatcccggtctcctcctcgatctcccttctggccgcctctgccggattctcccccggctcgacccgcccggacaccagagaccattttccggggaatgaatgcgcatcctccggcctgcggagaaggaggactttgccaccgcactcgagtacggcggacaccgtggaatatgtcttgacgttctttatctccacatatcccctgttcccgtccacggctacggtatccccgtccctgacgagggatacatcgatattgtcgaccatgggcaccgatgagatcacggcaccggtcgtgactatcgtctcggcactcctgttgacaagtgccagaggtgcgtgtccctgcaccttcagatcgtataccacatacgatccgaccgtcgatcccttaccgttggggaacaggaagaccttttctgcgatgtttccgtcgcgcacgttgaagttccccgtcttgccgtcgacccctccgaggaaactgaaggcccccccgtacgttatcgcctcaccctccgcgtatccgggggagatggcgcgtcctttcatgatcattctatcaccttcagcaggtcggagatgtccgcaaacttcaccttctgggaacagagggtcggcagatagttgccggccttggcggaattggtggccgtcctctggaacgtgccctctatcggggccacgaccatgcaggtatcggccagtacgggaccgaactcctccattatcctgacatcatcctggcactgtgaacggacggactcggacgtacagaaccacacctccacatccttgttctttttcttcttccctttgagaagggccgctatgtcgtgcatctccttgggggtgaggtgggggcatcccaatgcgatgagctggacgtcctccaccgtgttcagcttgtcataagccgccttcctctccgcatccccgatggatatgtgctcgagaccggagacgtcgaagtccccggcctccggggtacacccttccgcatgccagagggccaccgacccggcggctgccatagccgccgacagggtcttcgcatcctcgatcgatatatccttcagacccctgaaataagggatccccttgcctatggccatccccacggcctgtcccaggacggaatagtcgaatacggacccgcccatgtcctcgacgtctacgacgacggtgggtctcctgttctcggtaaggtggagcccgtagttggcggtctttccgaggatggcggcggccaacgccccgggtccgccctccctgttggtcctggccccgaaataggagttcaccacggacagggcggacgactccgcccatgcgacgtggtccccgaacccggggacgttgtccccgatatacggggtgcaggaacacgtcttcctgatacccatcttcccatacagctcgataatctgcagctgcttctcggcgaactcgggaccgatatgcatctccttccaacgctcgcggtccatccccaccgggttgagggtggatgggacggataccttggccccgccggctaccatgtccgagaggtacttgagaccgccctctccgatcgtcttatatgaagcacccgaaaggtgggcggatgtgatatccacgagactgtccgccccgtagatctttccgagggcgacgaccagttccatggccttctgggcaccggcgcctttctcgccgtcgaatatggcctgctcctcatctgtgagaatcatacttcataatcgccgtatggattatatgggttgctttcggcggaccgcacccgtccgtcgatgttggcaattccattgatatagattgaagacgagtcacaccggacagatgtccagagtgtccaagaacctacgcagcccgaggatgtccctccgctcccgccttaccgaggagcagttccgcagcacggattaccgcagtctctggaccaaacgctccaacgaggagtggataaagcacatcgaaagggtcagacacatgagcgacgacccgtatccgaatcccggggattggatcgggcagagggtcgacgaatattggatcgacggcatgcaggttttctgctggggcagcaggcacgaacaggggcagcccgtcctcatatatttccacggaggcggattcctctatcctcccctcaggtcgcacttcgagatggtggacaaggtcgccaaaggcataggcgccaaggtcgtattccccatgtacggcaatgtgccagaccacaattacaagacggaattcgccaagatcctgaccgcctacgagaccgcgttccgcaagaaccccttctcccagatagtgctcggcggggactcggcgggaggaagcatagccctcggattctcctactatctgcgcgacaggggcatgacgatgccggaggggatacttctgttctccccgtgggtggacctccatacggacaacccggacatagagaaattcgagaacgtggacccgatgctggatgcctggggcctgggacttctgggtatctactgggcggacggggagaagaacctggacaacccgtacgtgagtccgatattcgcggatccgaaaggcatcagcagggtgttgatcttctgcggcacccacgacatactgtacccggacgtcatgaagttggaccggctgttcaacgaatacgacatcgaccacaataccatggtgtatcccaacatggaccacgtcttcgtcgcattccccataccggaggcgagggtcgcactggatcaggccatactgttgctgaaggattggctgatgcaccccaattgaaggcgacatgggaccatctgggtctttcgattgagaaggctctgtccggtcgctcaaacccccgtaacccgatcatcgccagattcttcagggaagcgaaactggtcgagggttggggcagcggtatcggaagatccttctccctatgcagggaatacgggctgagggaaccagtgatccaggagatcgatgaggcgatacgcgtcaccatattcaggaaggattcgtcacatgtgccttcggatgaaccgacgactcttccactatctgatctggagaaggacatattggctttgctgcaaaatgaaccgatgcttaaaatccgcgagattgcagccaatctggataccggagaatcaaagattaaacacgcaaccgtcagactcaagaaacgtggcctgttgtcaaggagcggttctaagcagtcatcatattggaaagtaaacctgtgagtggttgaactactgtgaacttctagtgaactactgtgaacttctaaattaagtcaggttatatttgataacgaaggaagcagtgaaggaactgatctatatagtcggttacaacaagaaagaatcatccagttcattcgtaaagtcggataaggagaaggattactccttatttgactgtaagatatccaatatcataccagacagcaagaagccgtatcaaacacctctgtgaaattggatatgtcaaacccgtatccaaagacagaaagacggttccttatactgtgacggatgacaaaacaaaatggaaagtatgatttgttgtttaatgtaattcaccaattcctggtaaacttgcatcctttggaacgatagttgctgcacccgtagaacttatgcccgttctgattggtcttcaggatcatcactccgccacacagcggacaagtcatctcgaccttcttcccatatgcgtcgttcctcgggaacatctccttgaagaaatccgactggtgaccgttctgggagacgatatatgtcgtctccttggccctagtcatggcgacatagaacaacctgcgttcctcatcgatctgactgttctctccgcccaggagcatcgacgagcattccccggaactggcagcgcagatccgctcccacggcatggaggaaggggacgtggtgctcatcggaggcagcaacaccggcagaagggaggccgccgtggcggccaactccgcggcgctagagcttgtaggttgaaacctaacgccctatgaatattacgatgacagaccgttctgccaaaggatactttaaataatcgatagaagatagtcaaccatcctgataagccccgcagagttggccgctatcggagtggcccttataacctgcgggcgaaggatattttgtcttctataatggatagtttggtgtcaccgcgttcgtatttggctctcacggaacctgctacgaagtctaccagttgcaaacacggtgtgctctttgaatccctcttcctcacttctaggagattcacacccgacctgacggaggattcgcggacgatctccctgaacctttccgtcgagatgaacctgttgttgtcgagatagaccttgacatccctgcaaccgagatgggacagggcatcatcgacgacctggcataccatcctgtcatagagctcgtttccgtacacaggtgcatctgacagcggcttgttctttttgattacggaatagacgataccgaatctgcaccggcccattgcctcgaacagttcgagaatctcatcctcatcggaattgtaccacttgtgctccttgccgtccttcgggattgttttgtaggcacttttgagattgcgcgtcctggggagaatcattgctgccatagcgaaatactcggaaccctttgggcccagatctccggattcgtcgataaccacaatgtctgtcattctgtcatcgttcccgattaacgtgttactacaatgaattacccgtttatccatgacaacccactgctacgccgacaacgaatagactcgggtcgggcggcgacggatgcaccaccatcatcctccgcgacggggagcttatactccctccggactggagcatcgacgagcattccccggaactggcggcgcagatccgcgcccacggcatggaggaaggggacgtggtgctcatcggaggtagcaacacagggatgagggaagcagccgtggcggccaactccgcggcgctggagcttgtcgggtaaaaccgcaccgaagtcgcttcggccatcattccccgatcagacgatcaatcgcaatatcccatatcctcgatcgatacctcgaaatggaatcaatcagtatatcaatatggaatcattaagtatatcaatatagaatcaattgcagtactggcgagtattatggcgaacatcggaagagaggacgaaacacaggaattcaaagagagcacggcagagatgaacgaagcgatggaagcgatctgcgccatgctcaacaattccggcaaagcccatgtgttcttcggagtcagagatgacgggactgtgatcggccagatgattggaaagaacaccctgaaggacatctccaagagcgttcgtgaatccatcgaaccccccgtgattgccaaaatcaaagtgctgaacacatcggacggaaaggagtacatctcggtggaaacccagggtaccgcccgcccgtactcggtaaaagggaacatactggtcagaaccggtgcggagaaccgcaaggctcccctgtcggagctcagacgtatgatactgagctcgggcgataatcttctggacacctcctcctataatcaggaactgacattcaaggaactctgtatcctgctgagggacaatggtttcgacgttcaggacgacgaacgcctgaggaagagcttcggtctgctgaacagcgacgggagactgaactatcaggcacagctcctgtccgatcagaacgatatccccctgtcggtggccatgttccgcgggacggacagatcggacatgaccttcaggaaggattacggcggacgctccctgctgaccgaggtcaatcaggtcctcgacttcgtacaggctcagaacgaagtatccgtccaggtaggtccgggaagcaggaaggaaagagaactcttcgacgggaacgccttcagggaggcgtggatcaacgcgtgcgtccacaacaactggatcggccacatcgcacctaccgtccacatattcgacgaccgcatggaggtcatatcctacgggagcatcccgtactggctgtcgctggaggatttcttctccgggaagagtctcccggtgaatgacgccctgatgagagtctttgtacagacgaggctgacagagcacacggggcacggcatcccggtgataacctccgcctacggaaaggaggcgttcgatctgaccaacgggacggtcaccgtcacgctcagattccgcggactgcgttcggcggcatcgagacatccggcggacgccccgcttacggaaagggagatgagcgtattggatgccataaggaccaacccctatgccaaactgaacgagatcgcatacatgagcggggtcagcagatcgtatgtggggaaggtggtgatcaggctgaaggaaaagggcctgatcgaacgcgttggcaaccagcgtacggggtactggaaagttccagagaagacatgatgctgtctaaaactgctccgatcatcagtcgaacgtgtctttaagtatctgatacccgatgattatgcatcccgataagacccgtaagtcggccgccatgggtggccatcaatacttacgggcaagggatcatcttctcatcgatccgaccctcacgtaatgagagtccaaaatcatcgaggacagcttcagcaggacgtaatcggtcactgccacgcttccttgatcttcttgatgacttcgggatccgtacagaccccctgggtagggccgggctgatatgcgccatactgttcataatcgtcgatagccttagctagattggctgccgcttccggcgtatcgatgaccatggtctcgtaaaatgatttagtagccatatcgctgcctccgaattaccagattctccacattttataaactcttgtattaatccgatgatctgcaaatcgttttgcaagatgtcgttatgaaccccgagacaacaaggctcaccacattaaggcaattctcaccgtcttgccgatcccatcctgatcggatccctgctgatgtccctgatcctcaggactatgacctccagcggtacgccggtctccgccgcgggcctcagcgagaactacactcgtctcatcctcgggaaactggaggggatggggttggtggacgtctccccccgggggatgatcgtcaccccgctgggatgcgacctcctacggaccttgggattctcgctcatggagatcgaccatacagattccgcaatagggacgtaccaggtcgcgctgctgctgaaaggaaaagcaaaaatgatcgggaagggtgtagagcagaggaatgccgccctcaaatcgggcggcgacggatgcaccaccatcatcctccgcgacggggagctcgtactccctccggactggagcatcgacgagcattccccggaactggcggcgcagatccgctcccacggcatggaggaaggggatgtggtgctcatcggaggcagcaacaccggcaggagggaggccgccgtggcggccaactccgcggcgctggaacttgtcgggtgagttcaccggacaatcctatgtcctttaaccgattattgtgtgcacagagcaaatagacacacagcaaggatcctcgtatggatatgcgcgtggactaagcacccactaagcacaatttgtgattattttttcgaaaaaataagatttttcacaatcttatatataaagagtgaacattattataatcgattttgtctaacaatcatcgaacggactaagcacccactaagcacccactaagcacccactaagcacgctcatgcccaataaggaacatatttgagcatacgagtggaagtgttttcgtcgactgcctttatcagattcctggacttggcggcctttatcagagtggacatttggacggtactgtaatttgtcgtttccaatccgaaacgttcacgaagggaggagttcgtaagatacccgcccttggtgaaacaggaacaggcgtgcatataacaattccacagacgttcctcggagctcatatccgcataagatgtcggaacggtcaatacaacccttgtgccgttttcgtcagagtagacggtcggtacagaaaacatatccttctcacaggattccactatcttgtcccaaccgctgccgagctcctcgcagagtttgattctacgcatcatggtcgcgaccttctcattccttgacttgggggcggcatcaatcagcctttccttatcgacaagaatcggacctgagttcgttatctctacacggttgctgaaaacctctatcgccagattcatcccggaggatgaaagatcctgatgtatcatcgcattagccagaatctctcttatcgcgacgacggagtattgttccttcagctctgccttgcccgtcctgatgacttctgaagaaggcaacatgagcatcagggcgcggatattatcctcaaaacctatggcgtatcctctcacatcctgcgtctgacgagcgatatcggatttggaatcgccgttgtacttaacgatgcgaagcgctttgcggcccagtctgccaaacttcgaaagatccttggcgaacaagagggcaccaagaacggtcaccgtgtacaatccgttatcctgtcttacgattacatcattatccgccaacacatccattaatgccttttcgctcatgggatctggcagattcagcagggttaggaaggaatcataggcaagcaaacgacggatgtcttccggcgaacaatcttcggcagcgaccatcatctctgccctctggctgttcaaagcgaaccaaagctttgatgcaagttgaggtctgtctatcagtttcttcgtataactgccgtcacgtatatattcgcatttatcaaatgcgactgggtactgtcttgatgcataaatcgtgaggataatcatgcgaaatccgtccactgttgtttcttggaaatcgaaatcagcatttttagacagattgttgtgcagccagctcatcaattcctgaccgccgaccttctgggtttcgggtttaaaagtagtgcccagaatctcgtgggtcttgtcttcaacaccccagatgacgtatccgcatgaacgaccaagcatggctgcactgttggcgattccgctgatacgttccgcaatcatactgggctcattggtgttatgtttgaattccagccacgggctctcgactggattgctggccaattctttcacaagtgcacttaaatcctgcataatccctctgtggttattgatgagcaatatggaatataacttaatctgactttcggaagagaatcttcaccacggtctgaaataggaatgaacgtgtccctttagatttatatcattacctgaacggcagaattcaccgtttcacagaacagtttctccgtctagccggccccatcctgatcggatccctgctgatgtccctgatcctcaggactatgacctccagcggtacgccggtctccgccgcgggcctcagcgagaactacactcgtctcatcctcgggaaactagaggggatggggttggtggacgtctcccccagggggatgatcgtcacccccctgggatgcgacctcctgcggaccctgggattctcgctcatggagatcgaccatacagattccgcaatagggacgtaccaggtatcgctgctgctgaaaggaaaagcaaaaatgatcgagaagggtgtggagcagagggatgccgccctcaaatcgggcggcgacggatgcaccaccatcatcctccgcgacggggagcttatactccctccggactggagcatcgacgagcattccccggaactggcggcgcagatccgcgcccacggcatggaggaaggggacgtggtgctcatcggaggcagcaacaccggcagaagggaagccgccgtggcggccaactccgcggcgctggagctcataggctgattgttttaacctgttcccacagaacactgattgaaaacagttagcgtaaagtccgcgtcttatgctctcgcttcgatgtactcgtcgatatctatgacggtgttgtcgagactctgccactgcagggcaggttcctccaaaaacccgaaaacgccgtacctctcgaagagctctatcgtctgaggtgcggtgagcccgtgggccctgcggtattcctccacacagtacaccttgaacttcacggtatcccgttccatcatgccacctccggccagtacagattcccggacctctcgtcctcatacagttcggccagctggagcggcccgtaatgccagaccttggtctcctcgtcctggagacatccgtagacacgggagagcatgaactccgagattgctttctcctccgaccaaccgtacctctccatcaggaggcgtacgacgtccgcggtgagtccgcgttttatcacctcgaatctgtctaggtccatcattccacctcccagctgtcaatatatgtgatgcattccagggatttatcggtatggaacaggatctgcccatcaagcttcgcactgttcagcttacgattgcttcttcacgggtgatgtaaccgctctcgaagaggaacagcgtatcgtaaacgctgtcatctgcgacgggcccgagtattatgtcataatcgtgggtgaaagtccccttgcggttacggatgatgaaatcgaaccattccgcggaaggtccgtcgaaaatgagaacattcatcccgggtttttcctcataatcaaattcagtcacgaatgcctcgggggagtcgcgcctcctgcggactgatctggcccatttctcggcttgggtgcgcgactgagtggtgtaaaatccactaccgaaatccatcctgcgtttggagtggagaatcctcggcttttgaaccaccgtgtcgctgccgtgatagaccttcatgttatcaggaccgcttcatgaacatttattgattgctcccagccggcctactcatttcgattagaatagacttttcccaatcgaatcaaatccataaaacgtcgtgctagcaatacttgcatatatgagcctaggaactaccgacactcggcgggacggagtacgatttttttgggattgtagtgactgccactgcaacgaactccatagatctggatcttcgatagaaatacaatgaagaacctgtgctgtcgcgaaactgcccctaggaacagtcagatcggtctttaagtatctgattcctgatgattactcatcctgataagacccgtaagccggccgccatgggtggccattaatgcttacgggcaaaggacaacctattcgaaattgtttctgtttaaataataaggtagttttcactattttcacaaggtcattttcactattttcacaaggtcattttcactattttcacaatgtcattttcactattttcacaaggtcattttcaccgtctagccggccccatcctgatcggatccctgctgatgtccctgatcctcaggactatgatctccagaggcacgccggtctctgccgcggcctccacgcacccttttccctcggaatacagggcaacggcgcgctggaggtcctcctcgctgtagatcttgcggggctttgaaagaacccctctccaatccgtggatttgcatttggggcacatgtacggcctggagcccccgcgggggatccatttgtgaccgcacttcacgcaggacacctcctgcctccggctgacgttccattcggtggacctgcaggaggggcatctgcgcggtatcgaattgccgcggctccgccaggtatacccgcataccatacacatacggtcggtcctgcatatctccccggcacggtcgtcgcagaaggatctgccgcagaaggggcatttgattatcctgtcgggttcttcctgtttcaaagcgttgtctccggaatggagaagaggtgggctgtaataaaacctcgttaaatccatcaggtgaaggatacaaccctgcatgggtccagaaattacgtcgcaacgatggaatgatacaaactgatgataaggtatctgaagcaggaaaaacagatgagatcattttctcaacgctcttgcgagacagactcaaggaccacgctgggagagaggcctttccaaaagacgtatgcaaaaaataacgttcgcataaacctggatgaggggaggttatggggatctctccccacgtttattatcaggagaatgggactgcctcgtttcccctcagactcttgaacctgtacggcacctccatcgcaccgaccttccattgatacccggctttctcgacccatctccgcagagtggtcttgggagtcccgagaacgaactctatcgcctcatcggatgatgttccgatagcctctgtacttcgatatccaaaagggcctttcggataggttcgaataaccaattacctaacaacaaaccccgtgtgtaggccctttttgttccctttggttgttagtcgttctatgactaccaaagataatcctctggacccattttgggtgttacgcaatatgtgttatcatgttactttaggcagtataaatattctgaattttaagttacattaaaaacatcatgcttgctaacaagataggcgggcccgccgggaaccgcttaagtcaatggccagacatcagaaatcgaggtaacttataccccgtatacatgcataagttcggtaacttatccgatgaaataataccccacggaatgatgaattcagtcgtacatgttggacctgtgtcctatctcgaccaacaggatcacaagttttcctttgtcgatcttgctgatgagcctgtagtcccccaccctgtatctccacaatccaaccttatcgccggtcagtgctttccctgaagcgaacggattgtcagtaccatcaagatgtttggaaatccagttgagtatcatcgttctcgtgaaacgatccatcttcctcagctgcttgatagcatcatatgtatactcaacagaataactcactcttcatcaccgaacatcttgaggacttctgcgtgagagtatgtcttcggattgtcaaggtatctcctgtatgccgcttcgccgacagcgatgtcgtactcatcctcgatcttctcgaagagggcctgtttgaaagcctcacccatggaaacgcccataagcgccgcatatcttctggcgaggatttcttcatcttcagtgagtcttatcgagaatgccatttgatcactgataatgtgtagtacattgtactatttaaatgtccacgtgggggttcgaacccaaatctgatgcgggccccgccgggactcgttattgcaataggccagatgcgtataccaagtgtacattaaccccgtttttgcaactaatgtacgtacattgattgaatcaagaatttgattaaccaataacattttattgataatttgattaaccaataacattttattgatcccaaattctgcgcgtgctaagtaatcgcaatcctgttttctgatcaatttttcatatgctggctagggtacggtaagaggtgttatataccattacttacatacagtttatgttaggtaataacatggtcagaccgagggatggagacggaatcaaacgcacgatcgtcaaaagaggggacagattctatgcttatgaggtaacctctactatggaaaacggtaagaaaaagaccgtttccacctacttgggcagggtggatcccgacaccaaggagctgcttcccaagattcccgaaaaatctgcagagaaccgcagaaaaatcgcgaaagagaaggagatcgcgattctcaaaggtgtgtcgtcaaaggagtacggggcgacatacctgctgcacgaagtgcagctgaggatgtccctcggcgaggacctcatgagggcattcggcaattcggggaagaccattctcgcggctgcgatggcctatcttatggaaccgggcgcattcaggaacatagattccactttggagaggacgtacatccgcgaattctatgatctcagagcatcgatggattcgggaacgctttcggacttcaccaggaatctcggggagaaggcgatgaacatcgaccgtttcttcgaactcagggttaagggatccaatgggctggtggcctgggatacgaccaccaacggcacttattcggaactggaccagatggccgaatatgtggtgaacaacaaggacggagaggatatcaagcagacgaagaccggtttcgccacagacatgagaggcatccccctcatgttccgccattatcccggtacgatctccgatatagctaccgtggacaggatggtgtccgacatagaaagatacgggaagaaggatgctttgttcgtattcgacaggggattcgtttcgggtgccaatgtgaaacacctcctggacaaggggataagattcaccgcccctgcgaacacatcctccaaagcgatcaaaacgctgatgtccaggttcgtgaagaccaacgaatctctggatatgattcacgacggacatgcatataaggtgtggaagacgcagatcggtctgacggaagccgacaggctatccgcggacggatcgcaggcatactccttcacggtgtccggcgatgccggacacggggatgatggtatgatcaacgcatacgtatgtttcgattccaagaagtactccgacgaggtccagaaccacaagatgatgctcaacgatctgaagaggaaggccgcagagatagaatgcaaggatcctgtggccaggttcaagaagatcgctgggaaggcgatcaaacacttcgatgtacaggccgacgggaagaaggtgatcgtcaaggagaagcagaattccgtaagcttcgctgagaaccgcgcgggagtgttcgtcatgttatcctcatcggatctggactggtcgacggttatgacggcatatgacgcaaggagacttaccgaacaggcgttcgatttcagcaaatcggacgacaggaggcaccgtactcccgacaaatacacgatgatcggacgttcgctgataaagttcgtttcactgatcctcaaatgcgaactgtgcgctgagataagggaatccggcaaacgggagatgtccgtcggtcagactctggggtacctgaacacgatcaactgtctgagttacggttcttcgtccgctctttcggagatatccaagaactgcaggaacatcttcggaatgttcggagtggaagtacccaatgaacccgtcttgggcatcgaggtatgcgatctgagatgtctcgcaactcccaagggttgagttacttacacgcgcagaatttcggtattgataggcttataaatcaacatgcctcaaacagtaggtacggcagagaaatgcggctgtcgggcgaccaaactctgccatttatcttttcggatagaatttgatttctaacccacattcataatgatttgagtctgataacctcattcatcatcaatgggaaatcatcaatgaggatcttccaaattaccttattctccacacgcgcataattgtgggcgataaaatccctgaaactacagaccggattccaatcataagtagaattctcagataaccaaagacggataagcttggcattctctccaatctgctgaagattgaacaatactgaggatcgataatcataatccttattgaatgagtcgaaatcattaccgaaacggtgcatagtgaacgcaatgcgctgacaatactcgttcatcctgtctatggaagatcttccctttcatccataaacaagaacctcatctctgactacattgttgtagaactgatcatgttcagattccaaggcaccacgagtcatcacatgaacttctgaattgagtatttcagacaattccttctcgaaatagtaataatcactgaatgagaactgttcagaaggaaggatgcatacatcgaaatcgctgctttcatgctctgtgccacgtgcacgggatccaaacagccagaccttctcgatatggtacttggaaacaaggggaagaacagcatcagctaatctagagacattctcattagatctgatagccagtgccatggttattgattcccctgtctttataaataggttatttccaaaatcagataggtcgataagcagcaatttgtctgaaatataacacgatatgcaccataccgacagaatcagcaatcccgccgggactcgttattgcaataggccagatgtgtataccaagtgtacattaacgacgattttgccactaatgtacgtacattaatttttgattaaaatcaacaatttctcgctacctacaaaataatttgttgattaaccctttaaataggtctattttctgatgaaataggacataacatagcagaattcaatagaaaattgggacaaatctgcataagatcgcagctaaggtattcctgactatttttcaggtaaaccgctttaaaaatttaatgtacataaaaatagactgctgactaatgaaagtagcgggcccgccgggattcgaacccgggtccggggctccggaggcccctatgctatccaagctatactacaggccccttgggattatgtaaaattaagggcagaatgagtcaggaaaacgtggccggggtgccagccccggcatatggccccttttgagagggacggagccttggagattttccttcactctttcttgttgaattctgtgtatccgcactttccgcaggaaacacggtccttgtggactgccatgaatacaccgggtccgcacttggggcagacgggcttggtcctgacgagtttgtcgccctctacggtgtatgcgtccctcttcgatgcttctttcttgggtgctgcttctttctttgccatttaaatcactctgcggcgggggcctcttcctctttcttctcttctgctgcgattccgttcctcttcaggaggtgctcttcctcgcagtcgagggctgccttcttgtttgcgtagatcttggcgtagcccttggtcttgccgactccgtactctccggcaagctcgtcgatgacgacacacaccctctgggtgttgtacttcttcgcaagctcctcggctacggcgttccttccgggagtggactccctctcgtggtcgacaacgaagcgaacctctttcctgttgtacagggggttctccctctcgcagattatctccattttcatattagctcctccatactttcgagcagtttctcgatgtatgctttggaaagtccgtccgtgtcgacggccttcatccctctcccgggccacccgtagatgaccaccgcgccttcgggggcataaaggacgcatggcaacaatgccaggtcctcctccccttcgacacggatgatccctgcggacctcccggccaatgcgttttcgacggcgtcggacagctgggacgttatcgtccccgcaggattcgacaccaccgtttccgccagacctgcgtccctgacgaggtcggcgaacccggtgagctcgcgtctctccgtatatccgtcatagacggacaggaggggcacgatcccgtgcttcctcaccgtgagcgagaccacgtcgccgacggtgataatgatgtgtttagcgtgaatctgtgacagttcgctttcggatatgtcccgcccgacaggctgttggaacacctccctcatctcgggggtgagcctcctgcccgcggccatacccatcagcggaccttgagggcatactgaccgttggccgttatgcccatcttctttgcgatctccgacttcgtgtagtcggcgatggccaccatgccctgccattctttgctggtctctccgccgcagcgggggcaggtgtcgtcctcggtgatgaactggcaggacttgcatgccttgaagacctgtcttacgaccatcactcgtcgcctcctttcttccctttcttggaggcggatttctcggcatcctcctcggaatcgcccttgtgcttgttggcatcctgctcgatccactcgagttttccgagtccgggctggcgcatggtgagtccgatcttgctgtcctgaggggtcttctcgttgaggtcgatgctgaccaccctggccctgaccttgtctccgaccgccagagtcctgccgctctcctttccgatcagcctctggttgccctcgtcgatgtcgacgtggtcgtccatgatctgactgacatggaggagtccgtccagaggaccgaaccttatgaaggcaccgaagttgaggacctccaccacggttccctccacgacctcgttgtccctgagagcgaacacgagctgcttgaacttgacagtctggtataccgccccatcgccatggacgatgcgtccgggcccctcgggcacgacgtctcctaccagcactgcgatggatttgtcctcttccagcttcccctcgaaggtctcgctggagagagcgcctatgacgtccgaaatgtcctctccgagcttggacggagggatgcggacgatcttctgggcttcagttatcatatacatggcggatcctcttatacgggcggattagagcgaccctatattaaaagataacgaggagtcctttttatattattatatagagggaggtcggacgattggcccggtatccaaaccgagtctctccgcctccttctccaaggagacatccccgtcccctccgcgaccgaatatgatgcaggcgcgcgaatcgtcgcgatatcccgtaccgagggtcgccacagggttgacgaccggtctgccgaacactgtgccagcaagctgggatcctatgtcgcacgtcagagccactacgacatcgtatccgtccgggacgtcctcccggcacctgcgtacgttggaagctatgcatgacgcccccgtagacgatatgccgaccacttcgacgccgtcctccctgagtctccctgcgagggcctcggcgttttccctacccccgacatcgcatagtctggcacatgtgttgcaagtccatatcaggaccttcctgcccttgagctcctccagaagttcggggtaatcgcggtcgcgcaacatcatctgcaacggaacaacctccgagaagtgaaaaaaagaggtctgggtcagttcctcttgaccccgagcatcctgtctacgagggccacgatatcgctggccgaggcggaatacccgtcggccccgatctcgtcacaccattcctgactgcagggtgccccgcctacggcggtcttgaaggactcgttctcctcctttatatgacgtatgatatccttctgtgccaccagggtagtcgtcatcagtgcggatgccccgattatgtcggcgtggttctcccgggccgcatcgatgaacttgtcgggacttacatcggcccccaggtctatgaccttgtatcccgcgcccctcagcatggcgcagcagacgcttttgccgatctcgtgtatgtccccttggacggatcccatgacgataacgcccttgagttttcccgcattcttctccagaacgggggtgatctcctggagggccgcctccatggccatggatgcggccaggatctgcgggaggaagatcttcccctcgttgaactcgtcgctgatcctctccatgcctttgccgagaccctcgtcgattatgaccgccggatccatccctgcggccaatgcggaacgtgcggctgcactggcctttccgaaatccatctcgataatggaatccctcagatcgttcaggatatccttctgctcggcaccggccatgatcttcgcacctctgtttttacaacgggacgcacgactaatgcagtcctgcccccgaatatataacgtatcatgacgaggtttattatatgtttgtgtggacattttgagggaatatgcgcacgtgcgcgcactacctataaataataccgggctctcgtagcgctcagtgatataaatggtcgcaaagaaagagacctctgcagaaaaggaaaagatgaagaaacagctgaagaagatccccgtgaaggacatcaaggtcaccaaggccatgaccgtcgacgacatgctccaggccatgggacgtgccggaggattcaccgcacagaagctggccgacgccaccgatatcgcggagaagatggtgaagaaggagggctgccttaagatcctctccttccccgcctgcatcatggccaccggtacccgcggcgtcatagtcgacatggtcaagaaccacatggtcgacctcatcatcaccacctgcggatgcctcgaccacgacctctccaggctgtacgcggcatactacaaaggggacttcatgatggacgacgccctcctcagggagaacgacgtcagcagactcggtaacgtcctcgtccccgacgactgctacggatacgtactggaggacaacctcctgcccatgttcgacgagatcttcgccgagacccagtccatgtccacccacgagataatcgacaaggtcggagagaaactcgccgatgtgaagggacacgaggacagcctcctctactgggcacacgtcaacaacgtcccgatagtcgtccccgggatcaccgacggatccttcggatgccagctttggatgtactatcagacccacaggaagctcaggatcgacctgttcgctgacgagcagatgctctccgagatgacgaacgatgcgaaatacaccggggcgatcatcatcggaggaggtatctccaagcaccacgtcatctggtggaaccagttccgcggcggactcgactactgcatctacctgaccaccgcagaggaatacgacggttccctgtccggagccaggataagggaggccgtttcctggggtaaggtgaaggccaacgccaagaagatgaccgtagaaggggatgcgaccatcaccctcccgctcatctatgcgggtctcgccaacaggctcctctgatcaatatggcgaacaagaaggtcctgatactcccgggggacggccccggaccgtctgtcatatccgctgccgagaaagtcataagggccgcggcaccgggagtggacctcatccatggggagatcgggaacgtcgcttacgaacatacctccaaagccctgcccgcatccaccatggatatgatctcgacgtccgatgcgatattgtcgggcccggcggacatgtccctgatagatggccgcgaccccatagcggatatcaagagacagatgcacctgttcgcggaagtacaggagttccgtcccctggccggatatctggccgacagggacgtggacatcctcctcgtcagccactgcgtggatgccgtatccagcgtgagggagagcgaggggctggacggcgtcgtgtccgagctggataccgacgacgacgccctgtccgagctgttcacgtcatgcatgcacatagccgaggtcacaggcaggatgaagatctgcctggtcagagggatgggccttttcgaatcatcggaaagacatatgctggatagcttccactcccatttcgccaccagcgagttctccgtggaggatatgtccgccgagaaggccgcatgtctcctccagatggtaccggagacgttcgatgtcgtggtctccgggaccaccacgtcgcaatatctgagaggcctgctgtcggggatgatcggggggagcgggatctcccccgtagcatacctgggcgaaagaaaaggtctgttcatgccgtcgcgcacattcggaagcatgaacgagtccaggccctggaacccgacctccgccatattggcaggttcggagatgctccgctacatggggttcggagtggaatattcggccatacagaaggcggtctccgacatgtacgagtcgggtctgacgacctccgatatcggggagggacacctgtcccccgatgaatttacacagggtgtcatcgaccgcatacgcgagcaacagtgatttattaccgtacggaactacaaagacccagaggaatggaaatgaaggatacaggacaccgcgaggccgtggaggccgccctgagattcgagaagacggacaggacccccgtcaacaacttcgcgttggtcacggccgcacgcagcaacgggatcctggtgaaggatgcgagatacgatccggagatatcggcccgcgtctccgtggactatgccatgaggaccgaatcggacttcgtgaaaccggtggtggactcccagatcccgttcctggacatgggcatggacgtacgcttcccggacgacgactacggatccgtacactcgaaaatcgtctccgaaccggaagacgtggacaaactggcgttcttcgatccttccgtggccaaagaatgccctcatttcaccagatgcttcgtagacgccctggaggagaccgcgaggatactcccggaggacctccacatatgcggcctcgcatggggccccataaccacggccggatacctcatgggtgtcgaagacatgctcatggccctcatgatggggaacgaggagatggtgaagaaactggtatccaaatgtgccagattcgtggccgaccagcagatcaggatggtggatgccggatcaaccgtcatgtggatggccgacccgacatcgtcctgcgacataatatcccccgacatgttcggaccgttctccgccttcgccgttaaggacaccatatcccgcgtaaggaaggattacgacataccctcgttcctccacatatgcggcaacaccaggccgataatcccggaagtcgcggagaccggggcggactgcctcagtttcgaccacgccgtacccgcaaaggtcgccaaagaggaggccgccggcaaactggcacttatggggaacatcgacccaatagcgtacatcatgcaggggaccccggaatcggtcaccgaggaatgctacaggatcataggcgaggccggtacggagggagggttcatcctcgcccccggctgcgagacgcccatctcctccccggacgtgaacgtcctcgccatgggccgtgcgggaagggaattctggaagactcagtgatcaccgggtcatccggcggcctccagtcccgatatgcctatcaggatgagggttacggccgccaccttcttccaacttataccctcatgatacaggatacgtcccgccacgatggtggacagggcaccgacggccgtccatatggcatacgatatgcctacgctcatcgtcttcatgccccgggacatgaacataaggctcatgaacatcgcagagaggaacacaatataccagaaagcccttctgtccgtattcccgcctgcctttgtcatcgctatgacccagacgggctcgagaaggcctcctgcgataaggaagagaagtccgctcatggctacgcctcgttatggaaatggttttgatacggcagatctgcggaaagggccggtagacaacccttgtctttagatgtgccagcatcactccgactggttctccttctcttccttcgtcttcctggacggatcgtccacgtactgaaggagcagtatgccgccgatgagtattgccaggaacaggacctgcagaccgctcaggagctggtcgtagaataccagcccgaacacggtggacagcacggtcccgcatccggtccatgccgcataggaactccctaccggaagccccatacggaacccttggtaaaggaaccatacgctgatcagactgataccgaaagtgaccggggtccagaacagatcggtgaacccgtcggacatgttcatggtggtggcccatacggcctcgaacagacctccgacgaatatcattatccagggattgaacctcatgcgctcgcccccacgatctcgagaccggatataccgacgaggatcatcatgatagcaatgatcttgccccaccctatcgtctcggcatagaacaatctgctgatggctatcgtgaccagagcgcctacggccgtccatatggcatacgatatacccacactcatcgtcttcatgccttgagacatgaagaacaggctgcagaacatgaagaatacggagacgagataccatccccacttccttctgacgtcgtcggcatacgtgccgcctttctccaacgtgaatacccaggcgggttcgaagaaaccaccgattaccaggaacaccaatccgtccatgatttatacctcggaatgcgcattgcgcgaaagaaaagatttggtccgcatgatgcggaatctaccatactcatgacgagatgttccggggtattctgtcagtctcctcaaaaaggtcggtatgagggccgatatcggaatacttgacagtcatgattgaatgacaccccggatttatttaaggtttaggacgaatccgttcttccagcttgtcgatcatggagcggaactcgttctgggtggctatcctcttgcccatgtcggccacgaggtcgaacacatgctggacggaacgccctccggattctatgtccttctcgggctgtgccacacctgcgagatgcctgtgagggaccactatggacgttatggtgctggcacctgcatccagcctcgacttcatgccttctatcccttccacgtccagcgtggcggggatgaacctgtcggggaagagtatcctcatgacggctatggacttcagctccatgtaggaatccatcggttccaaggtctgcaggggggttccagcctgcgggacgaaggtcatgcagcggatctgctcgcatttctccgcacccatggtgaggatggcgtcggccctgtcctccatcgactccccgagaccgaccatcatgccgtcctcggtaagcatcccggcctccctggcccataccctctggttgtatctgaaatcgaaatcctgctccagacggagcttggaatacaggtcgcggttatgggtctcctgatagaccgcatagaaatcggctccggcggcctttatcttgggcatagcctccttcttaaccgcaccgggagaggccattatggatatccccaacttcttgacgcccgagattatctccaacagttcggaataatcatcagcgtacatgtgctcgtcctcgcccatagtgaggtctaccaggtcgatgccggcgtccttgaggtcggcggccaatgatatgatctcctcgggggacttcctgtacctgtctatactgttcgtacgcctgtagtagcagaacgtacagttattgtgacagtaggtggagaaatacacgaacccgtaggcgaaaacgtgcttcccgaactgtctgtcgcggacctccctcgcctctgcgaagagttcctccatttccctgccttcggcagaaagaagttttacgacgtcctgcgatgtcgcctgggcgccgttccttaccgcatccaatatatcgcttatctccaaagttgtcaccttgcatgaaccttccaacggccctagcactgtgcagcctcggcatgaaccccgtttcgttcaggaagatccaaagatgagaccacacagctgagcggcctcgtcctaagcgttcatgctggatgataacgcacattgtcttaataaagggttggatggaataacccttaagacggcctgaatcgtctgtcctgaccggccttacgctttacggatggctgccaaggccttgaataccgctatggcggcgtagtccggcatcctggcgatgttgtagtcgtccggcataccggccttggtattggcggccttgaacccctcatcgtccatgacgcggtctataagcatggatacgctgcctccgcagtccttgagtccgtatgccttgatgccgatggcctcgcatatcttggcacattcgtcttccgtgagcttgatcttgacgaagtcctcgataccgttctgcttcgcatagtactccagcttctttctgggcatcatgcatggtgaatcgggctttatgttcttaaaaggcgctaggcgaagggcggattatgccgtaccgatacaaagaggacggacgtcgctgtcaatattattaaccaggggcggccatatagagtatcatgacggacagcggggaactcatcagaagcagatacatcgacaaactgacccagctcaaggggaacgggatggtcaaggccctctccggaatgaggaatgtggggaagtcgacgatcctccgccagtatcgcgagagtctcgtggccgacggaaggccggaaggcagcatcatctgtgtggactgcgaatccctggacttcgacggcgtcgacggtaccgacatgatgaccgccaggatcagggaggccgccggcaacctggagttctacgtgctgtttatagacgaacccgagaaggtggagggctggaccgccgcactctacaaccttctgcaggaagggagatgcgacatctacatatcgtcgtccaccgacatagggcccattatcaaggggtcctcaataaaggaccgggtgcaggagatccgcgtcgaccccctgtccctgcaggagttcatggacctgaacgggctcacggacccgatatcctcctgcgagagatattcgaggatcggaggtctgccgatagtgagggccgacatggatgacgacctcgccatggccatcttgagaagcaccctttcggacatcctcttcaacggggccttggaccagaagggcggagacgaccccgagaggctgaaggccctcgtccgtttcataatgggtcacctcggtcaaccggtgcagatgaaagacatcaccgaggcgatagacaagaaccagctcttcgcggacaagtgcctcaaggcgatcacggagaacttcgtggtgttcgaacaggaggacgaaggttccaaacttctcaagagccagatgaggttctatgcctcggatgcgggaatcaggtcatgcatcagaggggccggtagggagtgggaggattatgcggacagcatggtctacacggaactcatcagaagaggctacgagatcaagatggagaagtacggcgagaccgcggcattcgtcgccgataccccgaagggtagggcatactacatggcctccccgaccgtcacaccggacgaggaacctgtcagaaaattcggattcggtcccaagacgagcaaaagaaggatccaagtagtcccccgctccgaggtctccaaaggaggaatgggtctgtccgacctcctcctcggaaacgacctggtcgagtgaggtcctgcagacgggtatgaagacattcccggacatccaccgataccgacagtacttggaatgtggagatgtccggaacacgaacccctcccaaggattccgaaagctgtccgggacacatgtgccagatgtcctcgtttcgatagacgcacctcatattcgtcacgggaatatggttgctccgacatcgatgtcggatccgaccgcattaggggacctgtgatatttaccggcaatcaccctaccaatctggtaggtaattggtagggcatcacatcttctttcccgaccaggaatagaccttcatattcacttccctgcccgtctccgtcaataatcccgcatccaccagcatcttcacatcggccctggccgtgttcagggagaccccgtactgactctcgatggaccgcacggtgacggtacccccattcataagaccggtgatcaccattatctgcctgtcattcagaccgtgatcggacagacttaccttcacaatgcgctcttcctcgatctttcttttaatatagtcctcgaatctgtccaccgaatccataagtgctttcagattatacaggatgaaataggtcatgtcgtttccgtcggattcaccgaatatgtacgattcctcatacttgcccttgtgggctttgatgtatctggacatcgcaaggtattccatcgaccgatatccgctcttaagctcgtaccaatagaacaatgtacgcaaaacacgtccgttcccatcctcgaaaggatgaatggatgccaacacgtagtgaaggattatccctttgatgaccgggtgcaggaatccgctctcatcattgatgaaatcgcataattgccggatagacagctctatatgttccctggggactggttgatggaccacttcccccgataatgaatcctgcacgacgacattatcgttgtcgcggaatctgcccgcatacttctcttccagagtcccttcggtcactatattatgtatctccttgatgagctccggagtaagctaccgatccgtatggtccttgatgaacatcatcgccctataattattcactatcatcctttccgatccgtctttgggacggatgttcttacgaagcatctctttcgctttctttgtggtagtcaccgcaccctccatctgactggatgcaatggactcctccatcagtgaactgaccgagtagtagacttttccgtgagggtcgatgacgttagggaaaaaatctgctgcggccctcacatcgaactcgcggagcatcttcataattctatccgacatgcaatagcgatattgcgtctttccgaagaccagcgtcacactgtcatccatacgaaccagtttcatcctggcccaaaccgtgtctggatcgaaatgaccggtatccctataccgaacttccgaccaatggagatacctcttgttgaaatccttcgcatatccttcgatctcttccgataggatgtctttagagatcctttcatccgacaaaatggattcgatccgaggagggtctctcggcagatgcataaatgaccataggaaattaattataagtaccctaccaatttggtagtgtattggtagggtattggtagggtattggtagggtattggtagggtaggagcccaggccccatcaattgggattgcatttactcctgttgcggatatcctctcccgtagagcggtattccccactgcgtgtgatgcgacatccgatgcatcgtcttcaatctcgaaagggacccggtcacctcttcctcgaatcccatcaggggatcaaggacggaatctccaagaccatcgacacaaacttcgatatcatagactacagcatgatattcagacatcggtaaaaggatgaccgcatggagatgaagaaaacaccgtcatcaatgtgccagatcctcaatttataatctattaagaaccgcctatgctcgtcggatccgttgaagaatcgttagaattcaaggacgatccccaggaattaacatcacaacgaatgcgttgcaccaaagcaatatgctgatttttagagaaattggtgcaagggacgtgatttgaacacgcggaccgctagggacaaggccctcaaccttgcgtcgttggccatgcttgactacccttgcactgagattccccataacggacttatttataagacttttgtccctcgtccagggattccgtctggaaaagataaataaacatgacctacaatggagaattcgtcaatagagagaggacggccgacggtaggacctaggtccagctgaggaagttccctcctccacgggcaaagatgagccgggaaatccggcagggcgagagccctggcaagggcccagaaacgacacagtcctggtaacaaggatgatccgtcagtcggtgacgttcccagggatttggtgaaacggcgactcctcatcggagcaagctcatacagccgggatgagatgcctgcgaccggcgggtagagtgcgttagttgaatgccgtctgaaacagaaggggggctactactctgaattgacactgtccgtcgggaatgctcccgacggacgacttctgcacatgtcctccgacgatatgttttttgaatatgatggagaatacatcgatatggcactcgacccgaagatcaaagccgtcggattcgacatggacggtacattcatgcacaccaaagtggactacgtaaaactggcccgcgtagtgtatgacgagttcgagagcctcggcgttcccgacgagatcctgcagaccgacaattacaaacttaccatggacgggggaatcagatggctagtggaacacgggaaatcggaatacgtccccgggatcaacgaacgcatcggaaaccgtgctaccgagatagagatggaacatgcggatatcgccgtaccattccccggtgccgtagaagtactcgacctgctgaaggaaaaaggatacaaggtcggcatactcaccagaggcggacgcgagtatgcgaccaccgtcctgggtaacgcaggcgtcctgaagaagttcaacgccttggtggcaagagacgactaccccgaggaggaggccaagcccaacccgttggcaatggaccatctggcggcggcactgggtgtgaagagcggggagatcctctacctgggagacggtatcgtggacttcatgaccgctgatgcgtccggagcgcagttcataggtgtggagaccggcccgaataccgccgagatgtggcgtaaaaaggcagggaatggcgtaaggaccattcccagcgtggccgaactggcggatctcatctgatccgcccatccagaaaaccaccatctgagaagaatacataactgcattactattctttttagaattatattagtgatccgccatttattttcaatcagtcttttcgggcgtaaatacatactataaattattctttttttgaatactttaaatataaaacaactaaatttattgtaaacaattgttaattagtagtacatatcattcatccacacttaccattatataatcaattgttaaattcatatccaactaaaatacaaaacaagtatgaataaaagaatagtgatatgaaatgacgaacaaggaagaaatcatcggaaggctcgcactgtccgtccagaactacaagagggcggatgcggcggcggccgcgaaggaggccttggatgccggcatagacccgctcgaggccatcaacgacggtctgctgaaaggaatgacgctcgtaggggacctcttcagcaaacacaaggcattcctgcctcagcttctgactgcggcggccgccatgtacggagcgctcgacatcctcctcccagcgatccccaaagggaaacagcaggaccagaagaaaatcaccctggccgtggtggaaggggacgtccacgacataggcaagaacatactcaagacccttctgaccgcaggagggtatctcgtagacgatctggggaaggatgtgccagcagacgtcatcgcggatgcggcgcaggagaatggggcgcaagtggtggccctcagcgccctcatgaccactacgatgttcaagatgaaggagaccctcgacctcctggacgagaacggataccgccaggatgtcaaggtcaccgtcggcggatcgcctacatcgcccgaactggcgaagaacctcggtgccgaccactgggacaaaaatgcccaggatgcagtccaatggctgaagggaggcatctgagatggtgaaaaacctcaaccatctggaaagggcggcggccgccctcgccgacgaggaggtcgacagactcgccacctaccccatagcctgcggtgtatcgagaagactgatcggagacggcagcgtgacctacagggaatggtgccagaatccggaaaagtatgcagagggattcgtcgcggcccagaaggcgttcgacctggatttctccatcggcctcatggacctgtccgtcctggcaggggatctggggtcccatgtgaggttcgacgaggagaacacccccttcgtcgacaaacccctgataaagacattggaggactacgagaagctcgagatacccgacatcaccaaaggaaggaccaacgtcatcatcaaaggaagcgagctcgtcgcgaatagactgggtgacgaggtcatcacctccgccttcgtggaaggtcccctcctcgtactgagccagtcggcaggggccgagaagctgttcttcgactcctacgaagaacccgggaccgtcaagaaggccctcaggaccatcacggaatacgacagacaggtcgtggaggcactgggcaagaccgggaccaaggcgatctgctgggactatctctgggccaattactcgtgcctcgacgacaaggagtacggggagttggaaggagacgttttcgcaccgtccctgaacgaggagacgaggaagaacgggatggcggtcgccgtccacaactgcgccgaccttccgcatctcgatacccagatcaggaagttcaaaccggcgatctactcgatggcctactaccctctgatagaggggtccaagaccgcctcacaggtcatcgaagaagggtatgctgacgagaccctggtcgcagggaacctcgatccgcaactcttcgaacagggtaccgtacaacaggtggagacggccaccaaggcactgtgccaggaggtgaagaccgctctctgcaagaggggcctgaagtccagatactgcatagccagcggatgcgaggtacctccttccaccacctgcagattggaaaacatcaaggctgtttccgacgccgtcaaaaaatacggaacgataggagactgacggaaaacgttcgaacgatctgccggaggggccgtcggtccctccggtccactcggatacagacacatgatacgatggagggaaaagaggaatgaacggatttttcgaagcgatgagggcgaaaggattctccaactgcaccaccgcatcggtcaggaaactcacatgcccggattgcggattccaattctccttggtctatgcccgcgccgtagcctgccaaggctgctcggaggcatgcaggggatgccccaaggtacgctgtgccagatgcgacaacgagttcttcctcgacagatccccggatgtagaagacaggatccaggagaggaccctggcggaccacatatgcaggattgtgaacgaccaccacgaaagcaaaggtatagagatcgcaaacaggtgatacaaatgacgataggattagggatcgacacgggcgggacatacaccgacagcgtcatcctggacatggattcagggaggatcctcagcagggcgaaggacctcaccaccaggaacgacctggtgataggcatatccggaagcatagggaaacacagaccggagctcctcaagaagatctccctggtctccctatcttccaccttggccaccaactcggtggtcgaaggaaaaggatgccgtgccggactcatcagcataggaaggagatacgacggcaccgtgacggccgacgtatatgcgcaggtggccggatcccacgacctcaaaggtaacgagaaggtcccgttggacgaggaggcggccaaggccgccctctcggagatgaaaggcaaggtggatgccatagccataaccggctacctgagtatcaggaatccggaacacgaggagcgcctggcacatctggcagacgagatattgggcgtaccggtcgtccagggacatgagctctcctccggcctcggattcaacgagaggaccacgaccgccctgatgaacgcacgcctgatccctgttatcaccgacctcatagaatccgtcaagaagtcccttgcgaaattcgggatagacgccccgctgatgatagtcaagggcgacggaaccgtcctcaacgaggcctctgcggtcaagagacctgtggagaccgtcctgtcgggaccggcctccagcctcaccggggccaaggccctcaccggtctgaaggatgcggtgatgatcgacataggagggacgacaacagacataggggtcctcaggaacggattcccgaggctcgataaggaaggcgccctcataggaggaaagaggacgagggtccttgcggccgccgtatccacctacggtatcggcggagacagcaggatcatcgtcaacgggacgaggatagaactcacccccgtccgcgtgatccctctgtgcatagccgccaccaaatggccccacgtcagagagaaactccaggatctggcacatcgtgtccccggccatgtggctgagaccgtgacggcggacgagatactgcaggagaccgaattcttcacccccgccaaaccgataaccacggagaccatgcaggaatgcgacagaagacttctggaactcatcgccgaagaaccgaagaccttggaggaggccggagacgccataggggtactcccgtacacgttcaacgtctccaggttggagaaactgggtcttgtcaccaggataggtgtgaccccttccgacatactgcatgcggaggaatcctacgtcgagtacgactacaaggcctccaaacaggcggtggactacctggccagaaaggcactgctgggattcgatgaattcgtatcgacggtcaaggacatgatcgagaccaagatcgcaacatgtctgatgaaggacctcctgctggaggacggaggattcgaggatttgggacctgcggccgaggacctgatccgcaaggccgtttccggaaaggacggcctcgacttcggagtgtctataaggatcaacaaacccatcatcggtatcggggccccggtaggtgcatggctgccgaggatcgccgagatcttccatacccagctcctcctcccggtggactccaacgtaggaaatgcgataggggccatatccggatcggtatccaagacggtgaccgtacacatccagccgaaggaaggggccatagggaccgaccccgcatccatcgtgttcctaggggacgagaaatacgagttcccgacattcgtcgaggccgtcggattcgccaaggacaaaggaagcgaatacgcggagagactggcggtggaatccggagcgactaacgtcgtcatcgaagtggacgtggagaagaagacgttcggaacggcgtccgatgcatccgtgcagatactgctggaagccgacgtgacgataagggccacgggaaaaccggacctcgtatcgtacagattccaaaacgcatgaaaacagggctgcctcggcagccctacctttccccatgaccgcaggggtcacttgaggccgtcgtggtctccgggacgcttatccctgttcagccactcattgtcctcgtcaagaaggatatcgcggtatttcagatccgtcctgtcgcggaagtcctcgctctcccagaactcgttggcgggattctcccggaatataacggcatcagccccgcagataccctccttcttcaactgttctatcgaatgggatacgaggctgtgaccgatgccgcgcctgcgatattcgggatccaccaccagatggtagaacctcccgctgcgtccgtcgcttccgcagaggaccacccctaccagacggtccccgtccagagcggagaagcagaattgcctgttcctttccaggaacctcgctatgctctcctcggaatcctctttgctggtgacacctatgcccccgctctccatccaaagacagtgggccgccatgtaatcctttatgtccgcattacgaaaagaaatcatgccggcgcccctgttcatcgtacggtcaatgcagtccattggttttatagtatcgtcttccggactggcacatcaaatcgattatatcggtgggaatcatccccttacgcaatgagattcggactcggaatagacacgggagggacctatacggactccgtcatcctggacatggacagtggaatgaccgtctgccgctccaaggcccttacgacccgtgacgacctgtccaaggggataaacgaatccgtatcgggcctcgacaggagtatgctgaaagaggtcgtcctcgtctccctgtcctcgaccttggccaccaattccgtggtcgaagggaaggggtgccgcgtagggcttctgaccataggcacggggtacgaccccgcggccgctcccgaattctacgccgagatcggcggcaagttcgacctctccgggaacgaggtcgaagaactggatgaggaaggcgcgaaagcggcactggagtctatgaaaggcaaggtggatgcggtggcagtggccggatatctgagcgtcaggaatcccggacacgagaatgcggtcagacgtctggcacatgatatcctgggcgtccctgccgtatgcggacacgacctctcgtcccagctgggtttctcccaaaggaccgccaccgcggtgatgaatgcacgtctgatacaggtgatagcggacctcatacgttcggtgaaggactccatgaaggccctgggtgtggacgcacccctcatgattgtgaaaggggacggctccgtgatgggggagacatccgccgccgaaagaccggtggagaccgtactgtcgggacctgcatccagcctcgtcggggccatggcactgaccggactgaaggacgccatggtggtcgacatgggaggcaccaccacggacatcggtgtgataaggggagggttcccccggatagaacaggagggtgcactcatcggaggatatcgcacccgggtccgggcggccgacgtctccacttacgggatcggaggggacagcaggatcgtggtcaacgggaaggagacgtcggtcacaccggtccgcgtcatacccatatgcatagcggcggcaaaatggccgcatataaaggaaaaactggagaccctgaaagatgtcacggacgaccgtgcggcggaggctttcgacatcagagacgtgtgccaggatacggaattcttcgtcccggcaaaacccctttcggacgaagacctttcggaatgcgacagggatctcctgaaggcgattacggaaggacctctcacccttaacgaggcggggaagctgataggtgtcccgccccatgcgttctccgcatcgaaaatggaatccctgagacttgtgacccggataggagtgacccccacggatatactgcatgcggaaggcacctacaccgaatacgacacgggagcttcgcgtatcgccgtaggatatctggccagaaagacaggcatgtcctttgacggattcatagcagatacgaaagcgatgatagtcaggaggatcgcatactgcataatggaggatatcatgcgcgagaggctcggcagagatgaattggacgaggtccataagacgatgatctcggagcttctgtctacggacaggggatgttacaccctatccatgaaactcgatatgcccatcatagggataggcggacctgtaagagcgtggctgccggctgtagccgatatgctgggcactagactcgtcctccctgaagattccgagatgggcaatgccatcggagccgtcacaggttccgtatccgagaccgtgaccgtcacggtgagggccaaacaggacgacaggtcgagagatcctggatgcatagtcttcaccaagggcgggaaaagggaattccctgactcggaaagcgctttggaatatgctgaaaaagaggcgaaagatgccgcagagaccatggcgagagaggcaggggccggggataccgtgatcgaatgcaaagtggaagaggtatcctccgacaccatgggagacgggatacgttcattccgcgaagcaagggtgaccgccactgccaccggcaagccagacatcctatccgaacgcctctcgtaagtgtggggatacctagttcgcggtcccatttatacgttgacatgtcatcgacttagatgactgcagagattgtgataccactcctgcagcaggaagagggtttctgactcctccgaaaccccttccgacctgcatcattcatcttcagggaactccagggagttctctttggccatcccttgtgcgagattcttggaaagcacacctatctccatccatgccgcatcgaatatggcattcggtacgagacagggtatggacagcggctgtctaatatcaggatccacgaccctgctgcccttccattccacgacgtccgaaacatggacttcccctccgagaagatcggcatagttcattacgttcttgcaatccgatgcgatggttatccttatggtgtctccatcatcctgcatttccgccgtgaccttggtattcctgctgcatgtcctcatacggactacgactgtagacgccatcatgggacgaacggagatggaaatatttacaaaaaccgtgcaaagtttcactgttcgatggatcggacccgatggtgacatatatccgaattccaacaacggatgaatagaataggcaatgtgccagatatgggaagatcggggcgccggtctcccgacgcccctgttgaacctgtttactcgtatccgcgtccgaggacgtgcttcctgtcctcgaccttggcctcatcggtgcggttctccttgaacctctcgatgttgtcggcaaaggtggtgttgggaggcatgatcttcttaaccatctgcatcagtgcgctgccgagggtcatgagaccgtggctcatgttgactccgaatctggtcattccgcagaccacgtgtccggggttcatgacgtcgtgggggtcctggaaggtcttgaagcccctcatgaagctgacggtgttggcgtcgtggacgttgtcgaggttccatgcgaagaagataccgaatccggtggtccttccgccgtactcgactgccctgtctccgagatagaagttgaaggcgaaggcggtcattccgagaagggactcgtcgtccttgaagtagtaaggcatgaacagcgaggtgttcctgtcgacgacctctccgatgactcctccgagctccatcttcatggtatcgaagcccttgtagcactcgtcgatgaatgctccccatacattggtgggggtgatgacctcggcagggatctctccgactccgaccttccttgcgcggaactcgtagcacctctcctcccactcgtggggtccgacggaggggtcttctaccttctttccgccgttcgcggcgaagatctcgtctgcggccgcctcctcgagggctacgtgcttctcgtctccctgcagggtgatgaggatgatgttcttcacgttgggggcgtgtacatgtgccctcctctggtttgcgaagtggttggaatcggaccaggagatgtgatagggcctgaggctcgggtgggctacgatcgcctggatggctgcgttcgcatcgccgagatagttctcgaactcgtaggcgatgggctttatgatgcctgcggggtgcatcctcatggtgacggatgcgaacaggcagagggtaccctcggaaccggcgaagagctggttgaggttgtatccggagacgtagtcgccgatgttcttgtatccggtgttgatgacggttccgtcggggaggacggcctcgatgttgaggaccccgtccttcgctcctccgtacttgtaggaaccgatacccattccgttggtcgcgagccatgctccgacggtggccgcagggaacgaagagggagtggatccgatgacgaatcctgcttcctggcactcgtcgaacacctctttccaggttgctccggcctgtgcggtgacggtcatggtgtcagggtcgacggtgaccttgttcatcttcgaggacatgtcgatgacgataccggcgtcggtaggctgggatcctccgagtccccaggtggagtttccgcggggggtcacggggattcctttcttgtaggcgatcttcatgatcgcggaaagctgctcggtcttggagggcctcaggacgacatcggggatgttcttgaatgccagacctgccatcttgggaaggggtgcgaggtcgtgacagtagagaagggtctcctcagggttggtgttgacgttgtccttgccgaggatgttctcgaactcgatcatggtctcgtcatccatcttgcgggcgagcttgtcgccgctcttggccttctcggagacgtcgcaggacctcaggtaggatttgagctccttcatgtaggcggcggtgttctcgtcgcggatgctgtcgatcctgtccttgcagaatgcgctgcaggtggtccttccgcccatggaggtggcaacctcgatcaggttgtctgcacacttctcgcagatgtggaagtatgcggtgtaggggtctgcgaacattccggagacctcgaactggaccgcgtcgacgaatgccgcccagttgacggcggggatgatgacgcctttgccgtccttgttgtcgcaggggcactgggggacgtcgatcttggatccgccgttcgcggccatgatctcatcggtgtcggcgatatcgaggtcgacgaacttctcgtcaccctggtagctgatagtgatgacgttcttgccgttcttgttgctgtagcagaaacagtagggcacgagaccggcgctgtgcatgacggcctgtaccgcaggtgcggcggcggagagtttgcctgcgaactcgtaggcgacggtcttcttcacaccggcggggacgagcttgagggtggcggagaccactaccccgaaggtaccctcggaaccggaaacgaactggttgaagttgtatccggacatgtatgcgccgatgtcgttgtaaccggtctcgatcacggtgccgtcgaagaggacgagctccacgttgaggacgttgtctttggagggaccgtacttgtaggttccgatcccgacggtgttggcggctatccatttccctacggtctcgtcgacgtcgaaggggtgggaagggaccatgaggttctcggcggcggccgcatccatgatctctttccaggttgctccggccttcaccttgaccgcatagttcttggcgtccacttctaccttgttcattttagacatatcgaggcggaccccgccgcaggcggagatgcgtacaccgaaactgttcgcaaccctggagacggcggcgacatcctcggtcgaggatactgccgcgcatatgcagcatttctcctcgttgatcttcacattggcctctccgacgatcgctttgatcttttctgcgacatcgttgatgttctcgctggaaagtttctttgaatccatggtaatactctccgctgtagacagcgcggttctatgggttcgggtagcccattttatttaataatattatcggaccgcacgacggtccgagaacctctccaaacgtgccctggacaccagttcatccgcggccccggaatccatcctgaaaagatgcgtcctgcagctgcagtccgaacacccgaatccgtccatctccgggatccctccgcactcctcggcgatgcgtgcgagctcgcactcccctatgaagtccggatacgactcccatgcctccgaaccgtcgcatacggtcgtgagacggtctatgtgccagcgaatgcccttgcagcgggccagatgacgggataccctttggtcgaggccgcccatggcactgcctacgtaacaatatgtgccagcacggaaaaggtgggggccgagggcccccaccgtgatgtttatgtccctgtcgaatgtcacgaagagcgcgtatgtgcccttcctgacactcattgccttgccttcagggaatcctcgtatgcgacctgcgagcgggtcttgatacgtatcagcatactgctgtcgttgatcttggacggggtgatcacgcacacgtctcccagacggcgtccgtagacctccatgttctcgatctgctcgtggtactcgtcgtacgatatcttggccctgagaccgtcgaggtgcatcaccagcggtgcggggcggagacacatgtcgatgggttcgaaattctccagaagggcctttatctcggacgggtggacgaacggtgggtcctcctccaaggccttcttcttctcgtcgaggacgtcgtcgacacggtctccgacctcttcgagcttcttcctgtcctccggctccctcatacgggccgccttcctgcctatgccccacactatggcgtcacaggtgtcctcgataccctcgggtttcggtccgcacatcaggacggtcgggatgttgatcttgctgagcagaagatcggccttcgtctccacacacggtttgaaattacccagcatgaagacgcatgcatcgtactcgtcgatgatggacgtctcctggaggttgatctgcgaggtgttcttcccgcggcctctggcgagacccatgaccaccgtcacggccccgagcctcctgagatactcggcgacgtcgcagataggatgcggcatgtgatgacgtcccagggtcgggcccaccacggcgatctcggtcccggccaacgggacctccttgacctgccctccgatgtccttgcagagggcctccacgacctccctgtcctcgctgggtatggacatggtgacggtgagcatctgtgcgctcctgttcttgaggaggacgacccctcccacatcctcgatcagctcgaatagctcgtcggaacggtagatcccgccgtcgtacattatgacctcatacattcggatcctctcctctgaccatcttgtcgtggatctcctgcgcctcgcgcatatgctccgggcggacgatctcctccgtagccatgacggttatggtgttgccgtcggtgaggacgcgcctgttcctgataccctccggcatgaccctccacagggccccgatgatctcctgcacgggctgttcctgggactccacctcgatggcgtccacctcggcggacgtgtcgggaccgcggaccgttatatccaacctgtcggtctgttggacgttgtccctcccgtatgccttccagagactctgcagggtgccgggggcgtacatctcgtccgagatgctgacatacacgttacccctctccgccctggtcatggcgacgtccccgatcttcttggcggcgggcctcgccttgagcctgatggagatgacgaagagcgggacctccggcttcagcaggaggtaggacctgtccaacatagcgagcttccctatgtcgtacatgatctcctcgtagaggagcttgtacttgtcgttcccgtactggtcgggaccgctcacgatggtttccgatgccatgtcagcgcctcataggaacccggagctgagcagggcaccgccgacggctccgatgtattgggagtcgtgggggactatgggctcctccccgaggacttctccgacggccttgaccagaccggagatcagggaagtacctccgacctcgatgatcggacgcctgacatcgatctcctgcaactgctgttcgtagacctgctccgccacggaatgacatgccgcggccgccacgtcctcgaacttcttcccgtctcccaggttggtgacgaggtcctggataccgaagaccgagcagtaggaattcatcttggcgttggcccagttacccttgaccgccatggccccgaggtccttgatgtcgatcttgagcctgttggcggtcatctgcaagaaccttccggatgcaccggcgcagatacctcccatggtgaagttgtccgggataccgtcgcggacggtgatggccttgttgtccatacctccgatatcgatgatggtggcctcgcctttctgcctgtccgccagccagaccgcacccttggagttgacggtcagctcctcttggaccaatttgcagttgaaatgcttcccgatggtgaaacgtccgtacccggtcgtccccatggcctcgatgtccttcatctcgacaccggcctgcttcatggcgttggccaacacctgctccgcggtttcgatgacgaccgcaccggacggggtccaatccttgccgatgatcttgttgttctccatgatgacggccttggtggtggaagacccggaatcgatacctgcggtgataccggattgtctctccctggccaggagctccttcctggtgacgatggtgacgagcgcctccatcctggtcagaagctgggaggccttcagcctctccgtgaaggaatatgtgacgacggggagcttggtgttctcctggatgaacctcctgagctcgttcctgaccaaggcggcctccgcacatctgaaacaggtggtgatgaagaccgcatcggcctcgaacttcctgtcggcaagactgaccgccctggcgatcatcagctgcagctgggtggacttgggcttgaaaccgaacctgtccaacgcctccttgacctggtcgtaggagacgtccggatagacgatcttggccccgacggcgcgtgccgccgactctatctcgaactgtaccccgctgtattccgtcccgcaggaaagctgggcgatcctgatcgtactcattctttcaatcctccgaggaaatcctttatctgacccaccatggtcttggcctccgcctcgtcggtggggtatttgacggtcagggcgggtattccgcgcctgtggatgaggtatttggtcagctcgttggagcggtcgcatccgacgcatccgaagctgaacggtgcgtcgtcgattattatggcggcatccgccgaatcgatcatcgggccccacagggaaagccttccccttatgccggagggcacttcgacccctgcgtacttgagacccttgacgacgtcgtccaaggtcacgttcatcggaggcatgtcaacctctatgttgtctactttctcctgaattaccgccatggagctcaggggctcgtggccgaacctctccaccaggtcgaacaggaccatgctgttggggggatctatgaaaaccttcatctgaatgcctcgcaaatttccttcatctgattgactggaactggtttcttttcgacgggggcgtcgtaactgtcgtcccccgcatctatgctgtctagggccgcctggatgagcgggaggcattcccactcggcctccaactgggcgaatccgggcctcgtcccgtgctgtgcacggcatctcctcggatctccctgggggtaccctctcctcttcgagaagacctcgttgcggtaggtcgcacgtacctgcgccatcaccttctgcatgttctccctcgtgctctcgacgaggcatccgtaacaggtctccttgacgctgaggccgtcgaccatcgtgtgcacggcgcgcacgagctggtcgggcgtgaccttcgagtccggggagatcatcaatatcctggtctctctctgctcgctcataacttatcctccgtgatgtatacggtctgctcgtcctcgagttcgtccagtttgcccatgtcgtcgtcgtagcgcccgatcatgttggtaccgtacggttcctcaccggtgggaccgaactccttgctgtccgtcagcctgataccgatgagtccgtgatggggcctcgactggttggtgaccccgaggtcccctttcttacacttcttgaagggctcctgcggatacaggtcctgccctctggcgtcgtccccgtagaatgtgaccatggacatgccggggaacgagaactggaccttcagttggccgatgggcttgtgactgagacccgtgacctttctaaaatagtgggccgtcctctcgtcctccgtggtcaccttgaccttgaggatcttctccttcggcactccgaaggtctcgatctcgcctgccgcgagggcgctcatcgtggcctcgggcgtctggtctgcgattatggcatcgtcggacaggtccccggacctcttctgcctgagaccgaaggactccaggaacctctgtccctccgcctgggtcattccgacggacaatatgcgctggggatccgtggtgacggccaccttgtcacccgccgatgcgcgggatgcgagggccatacccctctccaccgtaccggccacgtttatggcgggactgagctgacgcctctccttatagagcatgacgtgccccttcccgaccccggagttcctgacggtgacggtaccgacgtccctgacgccggtctcctccggctccatgtcgacatccatgtcgtccctgcaacccatgaacgtacctgtcccctcggacacgttgaagtatcccttggaagagaggatgaggacctgctccgccgacatgggcgaggcgggattcagcttcaccaggatgttggtgtcgatggaatagccgtcggccagcttgtaaccgaggtccttggtgattacgacgttctcctgactggtctcggatatgacggggtggacgtcgacgatcctctccccttcgtcgagtgcggcgaggaggtgtcttccgaccgttatcttaccgatcttgccggtaccgcagccgtacgccttcctgaacgccctcttggccaccatgacgtaggtggtctggttgtcgttacctccgagcgcgaagaagacgtcatagcgcttgtagtccccttcctcgtcgctctgggacatatcggaagggaacgaaccgaaggcggcgatctcgttcgtgctccatctcaggttgacgccttttatattctcgaccgaggccctgaaccttttggcatcatcggtgtcgtaaagatggacgaccatctctccgcgaggggtcatgagtgcgaaatcgttggacacctcggtgaccttctccgtggacagatggacggatatgtcggacccctcgatgtaatgctccccggccaccgcctgcttgagggtggccccctccttgagggtcttcggcttcccgttgacggttaccttcattccttaccctccttgggcatgatcttctgcaatttcgatacgatctcgtctagcttgtcctgaggacatgtgacacctctcacgacgccggtgactatctcctcgatacgtcctaccgtccccacgttctcggggtccggcatgacgtcgcgggtcttgacaccgatggatgcgaagtcctcgaaatccacgggacactgggtgaccactatggcgggcatgtccacgttcctgaggatcagcctcgccttgtagatgatgtggttcctaacattacccagatggatcaacgccaccttgtactgccttatcctctcgacctcgaggggatcgagaccgaacctcgtaccggtggtgacgtcgggagcatcggtaggaacccccgaacctgcattgaccaccaggacggacgcatcgatgccttcctccctgagagcgtaggtgatctcgcacaccggtttggtgatgtgcctccttccggggcccatcgcgatgacgacgacatcctttccgctctcggagatggtggccctctgtgccagaccccctccgatgccgagaccttgggactccctgcactccacgaagctcaggtgtcttccgatctgctgcttcattcaattcacccgcttattcctgttccttctggatgtcctcgtcgtccgaaccgcggaggtcgaactgcttgatgatgtcgtcgggcttcccgatggccacgaccttcccgttctgcatgaaggcggcacggtcgcagcaattctggacgaagtccatgtcatggctgactacgacgaacgtctccccgagggtctccctcgcacggaggacggatttggccacgatgaccttggtgatcgggtccatcgtaccggtgggctcgtcgaggatgacgatcctgggctccttgatgaggacctgtgcgaaagcgatcctctggcactctccgactgaaagcgtgtcgggataggcttcgaggatcctgttgacatccttcttgtcgaaaccgacgctgatgaggacctggatcgccttcatcttggcgagttccgccggcatgttaacaccgatgcaggtggaaaggttctgcaggacggtgtcgaacggatagagggtgtactcctggtgaaggactccgatgtaaggtgtggcacgtcctttgccggccactccgtccttggacatgtcgacccagtcgtctccgatgcggacctccaccttcccttcggtggcgggggacatgccggcgatcatcctggaggtggtcgtctttccggcaccggaatatccgatgatcgcgaagacctccctctcgtccacgttgaaggtcacaccgtctacggcttttacaacacccctgacgacggagaagaagtgtttctccgcattgtcgagtctgatgatgggctgtccgacgttgccgatctgtcccttctcgaagtggtacccttccatgaacttctcggtgatgggtttgggctccccttccatcttgacctctccggcatccagccagtaggccctgtccgccatcctgtctatggcctcgggccagtgggatgcgaacatcatgcagatgttgtgctccttcacatactccacgagcttgttgtggacgatctctgcggtataggggtcgagggtaccggtgggctcatcggccaggaagaagagcgggtccttggccagctgcctcgccatgacgatcctctgcttctctcctccggacaggtcccttgcgatgtgcatggtcctgtgtgccatgttgacgaactccaggagactgatggccttctccacgcgcttcggggtgcgctcgtctatggcctcgaggacgttctcgatgacggatttgtcgccgaagagggcgaaggtcctctgcagcatgatggcgatccttccgcgtatctcctctctgagggggtcatgctccggaagcgaccagtagtcgacggtctcgacctgcgtgtccccgccgcatttggagcagggcttcccttcgaaaggcaggtctatgtttccgcaggtgcagcagcggttgacgtggtagagtacgcgtccggtgtcgggtgcgtattcggtgctgcccctcagcatgtgcaggatgacgctctttccggcaccgctcctcccgatgagaccgacgatctccccggtcttgagggtggtgctgaagtcgttgaggacgactttgccgttgaacttcttgctcacgtgctctatcgtgattagttcgacagacttggacatggtcgggcggtacgggtccaaaatataaagatagtggctagcgacaaagggagttgtgtacagccctcacaagcagacgtggtagttgtgccagccctgtattggattggcgtcctcatagacatgtcgtatgcctgcgtcatgagggagaggatacctccattcgaccgaccttattaatattggatgtacattatatccaaccatggcaatgtcggaaaacagagcccgcctcggcggacccatccccaaattcaaggattaccacatctggaaggcgctgtactgcctcagcaaatccgcgcctatcggacgcaagaaactggccacccttgtgggggtcggagagggcagcacgaggaccatcctcacgatgctccaggagagcggtgccatatccgtcaagaagaacggggtcaccctcactcccgagggaaagaagatctgggcttccgtggccatgaacataaccaccctcagagtggactcgcttaccatcggcgccataaactgcgccgtacaggtgccccgtgccgccaataaggtgaagttcggatgcgaggaacgcgacaacgccataaagtccggggcggccggagcgaccaccctcatctattccaacgggatcctgatgtttcccggcaacgaatatcctctcgacataaaatccgacaaggccgtgagggcggcattcaacctgtccaacgacgacgccataataatcggcaccgccgatacaccggaggcggccgaggaaggggcggtatccgcaggcctggaactcctgggagggttgcagctcaaacaggagagcgaccccatgtactcccccctcagctccagcaacgaactcatcgcccttgcattcatggtgcacgacctcgtgggaggactcccagtctgtgccaagagcaaggacaacctggggatcaggatcgagaacggcaaggtcatagacaacgcatacaccggtgccgtcctggaagaggtcctaaagatcgggaccacgatcaggaggatcgccacgtccggaccgtacaaggggatccgtgtgatcgtcacacccctggaactcaacaacagcgtcatagcggccatcggagtcgtggacataaggactatggcagggatcaacaaccccatacgtctccacgaggacgacgacctgtaaacaaactacttatagaaccaaaaacagattacacattcggaggagtaaaatgtcggtcgacggtccggaagaaccccttgagattgtgaagaatctcagaggggtagtccatgcattctatctcagcgaggacatcctaagcaaaatgaaagaagaggaggccaaagtacgtgcggccggaggaaacatcgatgtggacaaccagggattctcccaggccctcacccgccagcacgtcatcgccatcatcaaagacccgaggttcaggccgcctccggaaccgaccgtcacactgatgtccgaagacgggaagacgatgggggtcgaggtattcccgttcaccttggaacagtacgccaagagggacgatgtcgtctggctctccgatgcgttcgtcatgttccccgaggtccatggtgacggcggggagaaattcgtcatgccgcctgtcagtttcccggagctcaatcccagcaacggctgcaagaacgtcatatcctgcagtcccgcacccacatgcgacctcctgatgaggcagcactacaaatacccagacgatccgaaactcgcgtcggtcctcatcgccttcgacgactgcccgaaggaccctagcttcaagacggacctgtcatcggtcaccataccgacgaagatctgagtgccgggcggggcctggccccgtcccgcatccgatctttctccatccgtatttagagtttttcgaccattgttccatccatatagaaaacggtttataacccctgattttcgagattcacatggatggagacatacccagatactcgaagcatcagctcgtaaaaaggtattgtcttctgggtatcggccttttcatcatgtccatcggcatcgcgatgtccaaaagagcgggcatagggaccacgccgatctcatgcatacctgccaccatgagcttcttcacaccgatatccatggggatgctcacattcctgttcaacgcattcctggtcgtcatagagatactgatcctgggaaaacagttccagaagatccagatactgcaggtcataatgggcttcgtcatcggggccctgaccgacgtgagcctcgccatattctcattcatagagccaggaagctatgcggaacaatggttctggtgcatactgtcgtgcgtgatcctcggattcggcgtcatgttggaggtacgtgccaatgtcctggtggcccccggggagggagtggtcgtggcattcgtcacccggttcaagataccgttccccaggatgaaggtcatttccgactccacgatggtcgcctccgccgtggtcatgtccatactgttcacggggggactcaacggggtcagggaagggaccatattcgcagccgtggtccttggattcatcgtcggattctaccggaaccgcttcggagaccgcatcgacagactcctggaatgacccagatcgagaaaaacttaacatggattcggcaagcaaacgccttataaccatccttccacataacaatagattatgttgagtctcaaccgctgtcccaagtgctcgaaagagacggggatcagggtcgtccctcccgaggatactctcgccaggataaggccccttatggaaaaagcaggcatggagaaacccagggatatcactggactggaccgtctgggtattccggtattctccatagacaggcctgcgacccgccccggggagaagaaccatttctataacggcaaaggtgccacaccggaacaggccgaggcctccgggatcatggaagccatggaaagatatgccgcagaacccagggatacggacgagatcgcctatggaacatacgagcaggcgaaggatatcggactcaccgtctatccggaggacctcatactgccggaaccgtatcacggggcatggatggggcagcagatcgcatggtgcgaaggttacgagatgttcagaggctgccccgtgtgggtacctgcctgtgcagtgtatcatgtgtatgtgccagatggggatatgcagctgttcaggtcccacaccaacggcatagctgccggaaacaccatggaggaggcgatactgcatgccttgttcgaagatatagagagggatgcatggtctatcgcagaatacaaggaagtggccaactgcgacctggtcatagaagacgaggactccgtacccggccaactgttgaagaaattcgaggataacggcgtccacgtccacttgaaggagatcacgacggacataggagtgaccacaataggtgcagcggcggacgatgtcgagaccaaagacccagagatgcttacgataggtgtcggaacccatctcgaccctcagatcgcagccatacgtgccctcacggaagtggctcagagcagggctacccacaaagacgggacgaagatcaatgcacagctccaaaaagtcacaagggacatgggatacgagggagtcaagaaggccaacccactatggttcaaagactgttccagcaaaaagaggctggaggacatccccaaccttgcaacagattacgtactggatgatatcgaggtcgtactgggacatctcatggatgccggattcgacatggtcatctgcaacgacctgacaagaccggagacaggagtgcctgtggtcaggatgaccgttcccggactcgaggtctccaccatggatcccgagagggagggcggaaggctcatagggatgtggcctccccccagatatcagaactgatcgaaaactccttccgtccgtcggaatggcggacggttttcttcttttttcgaataataggcatctgggacattcacagaatccgtataaaagacaccctgccagaaggcaggggtaaaaggtttattggatcaggtcggagcgctcatcctccgccggacggcatcatttcggatatgtcgacctctctctccatcttttccaggtcgtcgatattcttcttgttgccgtactctttggacttgcgctccttgaaggatgtggtcttgtactctgacggatcggccggctggatggtggaggccacatagtagaggcctgacgtatccagtttgatccatgtctttccgtcctcttccttaatgtccactatctttccgacagtagatgtcggggagtacttcaccacgtcccccttatccatacgcgatcatcccttgatgacggcagtcctctctccggcgggctggaactctctgagtccaccgcgtccgatctccttcgtgatgttcgcgaagtcgaagatcagagacttgtcggagaaggcgaccttgatgagcggggatgctacgaaggcgtctccgcgggcggcgtgagctgccttggggattcctgcgtatccggacaggtgtccgacgttcatcgcgtagttggggtagttaggtccacggacctccatgggcagaccctcgtcggacctgtatgcgtaggagttcgcggaaccgcactggtcctgcaggtcgaatccgtagaatccgagccttccggtcctctccttgtgctggagcatggactggtaccagaggttcagaccgttgtcagcgactccggttgccattgcaccggcgataccggtggaagcggcagtgacggtagcacgctgggatccaccgaagtgggtctccatgacagcggggtagcgctcgtacatctcaagggcgtaggacgagatctcgtctccgagcttgagctgtttgtcgtagtcgtcgggtgcgacaccgcagaatccgccgtacctgtcgttgatgacgtcgaccgcgtggtagacgtaatcctcgaggatgttgtcggtataggctgcagttgcgtactgggtgaatccgactcctccggacatgtatccgccgaggtagacctggtcgtagatgatggctccgagggcgacggtctcgaggactgcgcgggcggggtcgtcagggtagacacggtcggactgtaccatatcgtcgaggaatccgaaggtgattcctccgggctcgttgggtcccctgacacgccttgcgggcatcatggatcccatgttgatggacatgtgtttcgcggagtatgcgaagtcagcgatggctgcctctcctgctgcgagtttgtaggaggagatgaaagccatggaaatctgcattgcagcgtgcctggagacggttgctccatccatcacacggccgaccatggtcggaacgcggacagcctgcatgacagtctttccgattgccttcttcagcttctcagcctggtccttggggaagttcttgttgatgtcgatgacgaatctggggtccagctcgtcgatcagctcgtcgtctccggagaagaccttgacgtaggagtcgtaaacgagtgcggggttgcactctgccatgtgctcctgaacgactgctcctccaggcatggtgtggttgacggtctcgaggtacgcgttgatggtctcgggggtgacttcctttccaagccttctctcgatggtctggtgaggggagtcgagtccgacgaggacggtcctcctgatgtcgtcccaagcctgctggatggcagggttgttgatgcagtggaggtcatcgggctctacgaagatgtcggtgtgggacagctggtagggcatccaggacctctgtcctagcggaactccaatgtcctcgttcatcatcgggaagccacgctttttcgcgatctccatggcttctttctggaactctaccttgctcttagactgtttccatccgccgtagcagtagtacttggtctccatgctggtagggtcttccttgaacttcttcttgcatgcttccaagaagagcttctcgttagcttttcctgccatttcactcaccctttacgtcgaacggcctgtatccaccgagggtcctgagcttgtggatcctgatgtagaagtccgttacctctttgtcgtccctcatgtcgacaccatctgctctgaagatggtggtcctcttcttaaggtcggacatggatgcgggcttcccgacggataccctcctgtcgagaggcagcgcaacctggtctttcacatacacaacctctttcttctgatcgtcccagacgtacctctgccatccatcgaacatcagtccgttctcgtcgagacggcatgcgtgtccgtgaacggtggcacccctgataccggtaagagcggggtcgaaggtctcgtcgtcgacgagctcctttgcgatctgctcgaggttcctctcgcggacctcgatgatctgccttccggaaagggttccggtgtcaactcctctgtacctggacatgtacatccatgccctctggtagggggagatgggcgcgaagtagacggagtcggtgaactggatgtacctgaccctgtctccgtactttgctccctcgatgggctctacgagctccctgatggggcacttgggctctttgccctcctctatcggggggtgcacgctcttgtaagcctctccgggggccctgtggcccatgatcctgacgacatcgtccatggggacgtcacggagtttcttcagcttcactttggggtccatgtatctgcgcctgtttttggcggggacggactcaccggggtagaactgtctcttgtattttgccataattaagcactcctgtaatcgttgagtgtaggtctgtacttggaatatctcccgatatcgagggtgtagccgtcgacaatggtcttgtcgcaggcctccctgatctccttaaccacggcttcgagcatatcggagtcgtctacctctaactcgatgtagaaggcgcccacgagacagtggagctccacctcacgtccgtcgacatggatgatcttgcgctcggtatggttgttgggaagacccttcgcaggaccgctgctgattgtggccggaagactctcgcccgccatgttcacttgtctaatgtgctcgatcttgtcgatagcgttgagtacggcttccgtcgactcggcgctcaacaatctgttcgtcattatgcggacctcgggtagagggacgttcgcataatcgactggtggtttaggcatttacagacctcattctactcagagcttgttcttaatcttcttcgcctctgctccgacgaactgcatcggagtgttgaactcgggcattcctccgaagacatccttgaagagtccggaagtggcctctgcagagaaggtctgggttccaccgtcaaggcagtttcctgcggtgactgcgggtatgagggttcccttagcatgcctggtaacgacgtggtttccgtggaacagtccaggtcctccaccaccgtagatagagtgggagaagaaggacataccgacaccgacaccctccgcacgtccgtagtcgacaccgggcagtgcagactcgtgctcgagcaggtcgttgtagtacaggacagtggacgggacaccctgggctgcacgggcagctccgacgttcaccatgacagcggcaacctctccggctgctgcgtaggcgttccacttggggaggtcgtcggtggtgtacacgttgtatccggacggaagggtctctttcacgcggatgactccgtcgtcgattgccctctccatgagagactcgacgacagttccgacggttccggtctttccgttcttcttaacgagcgagtagacgaggttgttggcgttcagtccctggtaggcgagggacagaaggtgctgcctctcgaagggcccgatggcgtctcccatctcgtaggcggcgcaggtctcgaagagagacgagagggccgctccctgcatggcgttcctctggacgagggcgaccacgtggttggacatgatgttcctgagtgcgaaaccggcaccctcgttcatctggggaacctcaagaatggtcttgatgttggatccagcgaagttgacggtctgggggtactgtccccatactgcaccctttaccatgttggccttgtacataggtactttgtacctgtcgatgatggcctcggtgatggccgcagcgactgcggtgaaaccggtggtgtactcgacaccggcgttgagcctgtcctcagggacaatgacaacgatgagctttccgtcgttcttgacctcgacaacggtgtcgtcgccctcggtgacctgcaccatggctttgatgtcgtcggcgagtttcttggcatcctttacgagaggcacctcgatctcttttccagcgatcttgctgccgccgatctgtccggtcgcgagagctttctcgattccggccaggttgaccgcaatggtcctcttggtcagagaggcaattttctggattgccttgttgcgcaacggactgatggcttccagcggcacatcttttgcgatgcgcttgccgtagtcatcatacaggtctattacgtcctcgtattttggcattttatacctccttttttattcaatcccgcagaaaaaacaaatcctctgcgttccccttgcaaggacggagaatggctgaataacatataaagccattggaaaattgttatttttgcttaaaaaccagaaaaaccggaagtttatacagacccggaaatcacccgttccagatgtgccgccgacagcggttgtatttaatgattttcaacagtaatacgaatatcgatacggagacataaaaaagaggacggtaaatggtttcgaagtggcgttaagccgtttttccgggatcagtcccttttggccttcgacatggggccggcggcgtagcggtcaagacgcgacacatactcgggtatcctgtcgtacgggatccctatggccagttcgtcggccttcatgtcggtcttcttcctgcatccgaaacatccgatggagatgttcggggccgcggtacagaccgggacggcggtgacatcctcgcaggcacattggaagggggaggtggagaactgcacacgcccgcccttctccgccgtctccagggggacgatccaatagaccctctccggaatgtcgacgatctccacgacgtcggggacgaaatccgcctcgcccagaggacatacggcctctccgacgaccttgaacgggacgaccatcctgtcggagatcatctttcctgcggcctcgacggagtcgtgcatacccattcccgcatggaactcccctgatgcgaccttctcgggggtggcgatcatattgagggcggatgcaccgacatggcaggattcgtcctccagcgtcatggcgatgcaggcaccggccttggctgcgaagacggcctgacagtggctcatctgcttctcgggcctcttgcagcagtcgggaaggctctccccctccctcaccaacttcacggcgacgggctcgtacctgagcctgaggacggtcttgagtttctccgcataatctttgtttttctgaagtattgtatcggccattaaacggatattgttttcatgggatttataaggagccttaacgaaacttcagagctgggtccggtcacccgttcatagtaaggtactttatcattaccgacattatagtatcatgggaaagaagaatcttatttccgtcctggacatgaaggaccagtggccggacctcgtcgacctggccataaagctcaaggcagaacgcggacaccacggggcacccctcgcagggaagaccctcgccatgatgttcgagaagcccagcaccaggaccaggacctccttcgatgtcgccataaccgaactcggaggacacgcactctatctggacgtcaccaagatgcagatgggacacggcgagaccgtggaggacaccgccagagtcctcagccgcttcgtccacgggatcatgtaccgtgccttcgactacaagatgatggacaaactcggggagtgggccaccgtccccgtgatcagcggactcgacgatctggaacatccttgccaggccctcgccgacatggtcaccatcaaggagaagctcggatcgttccgcggcaagaagatcgtctatctgggagacggcaacaacgtctgcaactccctcctctacgcatccgccatcatggggatagacatggtcgcatgctgtcccgccaccaggatgcccaacgccgagatcatgctcggtgcggccaacatcgcggcggagaacggaagcaagatcgtcgcctcccacgacccgcaggaggcgtgcgtcggagcggacgttctgtacaccgacacctggatctccatgggcgacgacaccccggtggacaaggccatcaagctgttccagatgtaccagatcaacgacgagttgctctccatagccaaccccggatgcatcgtcatgcactgcctgcccgcccacaggggacaggagatcaccaacgaggtcatcgagggaccgcacagcgtcgtcttcgaccaggccgaaaacaggctccacgcccagaaggccgtcctgtacaccctgctcaaggattgaatcactacatacccagatcattaaacgatttattaggtgattaaaagcgactccgagtcaagaaatgcggtggcagaataaagctatcgctgatgaacaggctcggaatcgcctcaccaaaagatttttgcctcttttccaacagtccgttgacaactttattgtctcggctcgggcctacatcgctgcatcccacggtaccattttgccctttaatcctgggattccgcaccttttcggagcggttccgccgtgcgaacggccataccaaaatcgtatgcgtgctctggtcccggattctatacggatgttccgaacaggcaatcacagatcaccaggtcctgtccttcaccaccaatgtgtatattatgcgggccatcttggccgatgcggccacgatggcggaacggtccatgagtctgtcctcatcctgttcctttctcagttcgatgctccctccgttcttcttgttgaagaagagggtcaccggtgaatccttaacattcctgacatgcccgatggtcgcctgtataagcagccatctggcatgggggtcgcccttcttggtgatcccgcaatggcttaccgtctcggaagagttcctcaccctgggcgccagccccagggaggccacgaactgcttcggcccatcgaaacgttcaatatcgcaaatgaaacaggccagatacgcggccgttatctctccgaaatacggtatactcagaatcttttcatagatcgggttcccttggaatctagttttgatagtattcagcagttgatctcttcttttctccagatcctccatcataccgacaagggattctaaaatagggtcatcaaatccgcccatgtattccctcgcttcagtactggttatgcttttagggagaggtatcccatacaccaacgcgtgggagcggatgcgcctcttgcacttacctatctccaccatgtataccttagcggtacggcagagctgcctgttcatcatgtcctccttcgagcacatgtaacaaacatggaattgcttggcacctgcgaatctggccaccagataggtggccagttccttcgcatcgtgtttgtccgttttgctatcggattgcgtgatcttcttcagttcattggatggagccacgatataattcattcccagttcctcccatgtccattgaacatcatgtgtcttcgaagaattctccatcaggatctgataatcgatgttctccagatacatccgaacaagaatgaacccctccctgttcgaacggacgctcttgaacatcctgttgaaatccgttacaggtttcgcctcatcatcgaatgcgaagaaggtcgtcgttttcatatgcacgtctgcgccgattgcccacattcctctcatctccttcgctaccaatacgaacaaggaggcgtgagccggtggccggaggccacgggaaagacatcaaatacgtcgttcccgatttcgggaacgactcctttggttcgtttggttagcgactattgaatcgaggagtcgccttttaatcacgagggtactttcattggaacgtcttcgggggccattcccccggggacatattccgaaaatagagaggggaatgaaggaaaggccgacataagggggcagaactgacatggacctggtgattctcgccgtcttcggcatcctctccggaatgatggtccttgtacaatcccccgtgaacaccgccctcgggagaaacgtgggttcgcctgtcctcgcatcgttcatctcgttccttacaggcatggtattcctcctggcactgtgtatcttcaccgggacgaacatgtccatatcctccgatgggatcggttccaccccctggtggtcgtatacgggaggcatatgcggcgccgccatcgtcctgtctttcataatcctgttctccagagtgggggcggtgaacacagtggtcctccccctcaccggaatgctggccatgggtgcggtcatagaccagttcggactgttcggttccgagacgtactccgtatcggccctcggggtccttggtttcatcctgctcgccgcagggatggtgacagtggtgaccgttccgcgtcacgaaaaggacggtgggaaggaaaggataccgaatgaagatgacgggaacagcccgatatggtatctgttcgggatcggcgtgggggtcctcatggcctcgcaggcggccataaacggcaatctgggtattcatctggattcggccctgcactcggccctcgtatcgttcgttgtcggaacggccatcctgttcgcggcatgcctgtggaagaggaatctgcacgatgtcgtcctggtgagggagaaccgcgtcccgtggtggatgcttaccggggggatcttaggggccgcatacatcttcttcaatgcatacctcgtccccgagatcgggaccgggaccaccgtggtgctcaccataaccgggcagatgatcggcagcgtcataatagacagcttcgggctcctgggtaccgtgaaaaagaagacgggggccctacagattataggtctggcactcgtgtttgcaggggtcgttatggtgaagatgtcctgatcatccgcagagctgtgcggcgaccagtttgtccacctcttccaggaacgactcctcctttccttcggggatcgtggcaccggcggcgacactgtgcccccctcccatcccgcctacggatgcggccgcatccttcatgatctgggaaaggtcgagtcccctgtccgtcaaagaacgggaagccctcgccgataccttgacaccgtcgtcggccacggcgaatgccactatgggcatgcccgtatcggcctcgccggaattgagcaccatgccggccactattcccaccaccgtctcccttatctccgtaccggcatcgaaatactgcacgtgcttgagacggcggagcagatggttctccttcacatatgccagcgaggcggagatgttcttcctgtggtcgctgcggttcctctcggcgtccttcagggcatcgacgtcgcccatgcagatcctctctccggtgacggcatcgtcatacctgccgcaggagttcaggatcgtggcgaactccttcgaatcgttgagaccggagtgcacctcgtaacggttcaccgtatagatctcacccatcaaggctttcctgtcctcgtcgttcgtaagacgggacatgagttcgtccgccagcactgcacggtccccgggatccagatcgacccatgtgttccttctcccgtcttcggcggtcaactttatatcgtatttgtaaagaagatccatacacccgtcgcggtcgtcggttatcccttcgaccctcggttcgttaccatactggaggaactggagcacagggcgcgtctccctcccgaaataacggagaccgtatcccgtggatatgtcgcccgccttctcggcatccccgaggatgatgcggttgtaactcaccagccgggaatagcgatcgtcctggaaatccccgatggcaccgatgaccgccagatatgccagatccacattcttagggtctatcgtctttgagaggaggtatgtcatccccgcaccgcagacctcgaaggacccggagcgtccgtacaggtggggattcatctgatacgaggagaggaatccgtccaggaacgtctgtcctctcctccacagaggatctggcacatgatggtcggtgaccacgacgccgttacggacgaatctggacatgtatgcgctccccagatcgcatatccagaccatgtcgtactcgcacccgttgatcttgtctatggtctcctcggatatcttcttctcgaagtccataacgaactgtttccccaatctctccaacgtcatggcggctatcgaaccggccgttatcccgtccgcatctatgtgggatacgacctatatcctgcgggcggcacgtatggcggatgctgccctgttcagctccgtaacgagcctcggatccagctgggtagggaaatcgtcctccattatgccggcgcgtatggtgtcggatttgaatatatatcgcccccggcaaacgatattatgtcatgaacacctcgtcggagacatgggcgtaaggaagatccgcatcatgccgggggtaacgataaccaacgacagatgcctggtcctggacgaaggacctaccgcagtcataggagacctgcatctgggatatgagagtgccctcgaaggcgaggggatgttcatcccccgtatcaacacacggtccgtacgcgaggccctgaacagcataatcgacgagtacgaacccgccaggatcgtccttctgggtgacatcaaacacgatttccgtcgttccagctatcaggcccgggaggaggtccggcagatcgtaggactggtatcggatgccgcagaagcggtcgtcatcaaagggaaccatgacaacttcctccagaacatcctgtcggacatgggtctgctggcactcgaccacatagacatccagggattcagactggaacacggccatgtggactccggcataaggcccgtcataataggtcacgagcacccgtcggtgaaaatacccggggaactcagcggcggtatgaaactccaatgctatgttgtggccaggaaggaaggggtgatcgtgatacctcccttcagtccgttcgcctccgggaacgacctcaaccccggcccggatgcggtcatggcccccgccttgaaatcatgcgatgtggagaatgcggaggtctacggcgtaagcgacatgggtctgatggagttcgggaaactggaagacgtcagcatgctcaccatatgacccgggaggcggaccgtatgaccggcccgccccggatccgttttcccatgctggctatgtgtaaggtacttgtgtcagtcctcctcttccggcaagggccatatcttttcgtcggaacccttctccaccgacaggaatgcgcacacgcatgccgccaccatcatcaggaaagccatgagccagacgttctggaattccgccaatgtcttgtccgatatcatgaacccggcgatggtgatcagtatcgctccgcctgcgaatgggaacagattcagagcggccgtcgacgtccccgccatggctatcggatagagttccttgatctgggcataggctacgacgaagaaccctccgaagaatccgaacaggaagtttatgaccccttggatcgcgataccgtccatatgtccctttccggcggtagcccatataactccccacaggcaggtgtagaccagggtaccgatcaatatgaccttcttcctggagtggaagtacctgtcggaaagccttccggctatggggcagccgcataccatcccgacaccgaccatggtgaccatgatcccggcatcccccgcggagaatccgtatacgctcttgtagaacgaacccgcctgggaggcttgccacagcatgatcgtaccgtacatgaagaagaaccatatcgccagaggccagaagttcctccccgaggcgaatgtcatcttgagggcctccacggtccccatcttggcggacgtcgactcggtgacgggctccccggtctcctccgagacgatgtcctctattccgggaagttccatctcggacggatgattcctcacgatgagccagcacagacctgcgatgacgacggtgaccacagcgaggaagatgtaggtgttctggatcccgagaccgtccatgagaaggaccatgggggtcgcggcggctatgccgcctacgttcccgaccagaagcaggatgccgctcatggaggcgaactcgttcttcctgtaccagaccgccaggaccttcattatgggtatgtagacgaccgcggcgccgataccgatgatgaacttccctacgatcatgagggtgaaattgtctgcggcggccgatgccgcactgagtatggacccggctgcgataaggaatatgaatatcgtagcggccttcctcggaccgaacttatccgtgagtatcccgctggggatctgcatcagcgtatacgcgtagagatatgccgaggccaagagggcgacggatgccgtccctacgccgaagaagtcctgcagcgtgtcggagatcgctccgcccgtcgtcctatggaagtatacgaagaagtatgccagcgcaaggaccgcgaatatggcccaacgataagaaagcatacgcttcttcttctctgattcaattgtcatgattatccccctttttcataaactgtaacatccgaagttacgtggttgatttatctactaatggatattttagtccacccacggacatatacactgtcgattgtcgatacgatcccctgtaacgacggttggaacggtcgaccaacgcggacacggagatacgaaaaagattggctgtattgtctggctgttgataatgtcccaaattgggcattttatgtgggaaacgtttatcaaataacttatacaatgtttattttgtcattcttatttttatatgtttaaggtattccgcttccaaggagattaatatcatggcaatgactcccagagaaagagtaaccgcagctatgaacaaagagaacctcgacaggcccccggcggccatcttcacccagtccgcaaccatcggacagatggatgccaccggcgccgcatggcccgaggctcacaagaacgccgagatcatggcaaagctcgctgccgcacaggccgacgtgttcggattcgagtgctgcaggacttccttctgcctgaccgccgaggccgagaggctcggatgcaccgtcgccgtcgacaagaaggacgcggcacccatgatcaagaaccacccgttcaagttcgactgcatggagggcgtatacgacgaccccgcagcaatgatgcccatcgacgagttcctccagggaggacgtgtcgcagaggtcatcaaatcctgcgagctcctgaagaaatcccacggtgagaactactgcatcgtcgccggaaccaccgggccgttcaccctcgccggacacatggtctccaccgagaacctgatcttcggaatgatgatggcccctgaggaggtcgacaagtgggtagccgcaaccgcacccatctgcaaggcatacgcccagaccctcatcgacaacggcgcagacatcatccagatgtccgagccttccggatccaccgacatgctggcccccgacatgttcgaggaggctgctggaaaggcagtcgccgcatccctcggagccaccaagaacggactcggaaacgtcctccacatctgcggagacgcctaccccatcgtcgacaagatggccgcctgcggaccctctgtgaagggagtctccatcgaggagaaggtcgacccctacaaggcagtcgagaaagtcggaaaggacaccgtcctcgtcggaaacgtcggatccgttaagcccctcttccagggaacccccgaggaagtcaaggagggtgtcttcaggtcctgcgacgcaggattcggaatcatctcctccggatgcggaatcgctcccgcaacctccgacgagaacatgaaggccttcgtcgaggccgtcaaggctttccagcgctaagcaagtcaacaaacccgaaataaacgatttacctgcggacgagctgaggtccgcagggaccttcttttcaaaatctttatgtaggtcaagattatagaccggttcaaccagatggctgggatagtatagcctggttagtataggggactgtggatcccttgactcgagttcaaatctcggtcccggccctcccttctaattatcacaacgtgggcgaagccatcgccctctgcgtcctccggacgccttgcagtcaaaaacggtgaacatcatggtatggaacggaaagctcgagaaggtggatgacaacaggtggctcatatccagggatcagttccccggaatgaggaccgatgccgtgatctattccaacgacaggctcatcggcaacgttctgaacgacaactctcctcagcaggccgccaacgtagcatgtctgcccgggatcgtcggaaactccatggccatgccggacatccattggggatatggattccccatcggcggagtcgccgccgtggatgcctatcaggggtccatctcccccggagggataggtttcgacataaactgcggcgtccgccttataaaaacggacctgaccctcgaggacatcgacgggaaggtcaaggacctcatggacgagctctaccgcaacatcccttcgggactcggatccaaaggactgaccaaagtgggacagaaggacctctccgagatactggacatcggatccgaatgggccgtggagaacggatacggatgggagaaggacctggaggtgacggaggaagggggacacatgaaggatgccgaccagacaggggtcggagagaagtccagaaagagaggactccccgaactcggatccctgggatccggcaaccacttcctcgaactcgatgtagtggacgacgtgttcgacgaaaggacagccaaggcctacggtctgaagaaaggttgcataacggtcaccgtccactgcggatcccgcgggtgcggacatcagatcgctacggactatctccagaagatggagcattacatgaagacggagaaggtggacctgcccgacagacagctcgcctgcgccccgctctcctccagactcggagaggaatactacagggccatgtgttgcggtgccaactacgcatgggcgaacaggcagatgatcacccactggaccagggagtcgttcgagaaggtcctgggggattccgccgaatccatgggcatggatgtcgtctacgatgtggcccacaacatcgccaaaatggagtcccatgacgtggaaggtcacagagaggacgtcctcgtacacaggaagggcgccacccgcgccttcgcaccgggaaggagcgagatcaccatgaaatacagggattacggacagccggtcctcatacccggagatatgagcaccgggacctatgtcctcgccggaagacagggtgccatgaaggagaccttcggatccacatgccacggtgccggaagacagatgtccagaaagaccgccatagagaacctcaacatcgagaccgtcagaaaaaagatggccgaccagggcatctacctaagagccggatcggacgaaggcgtactcgaggaagcccctgacgcatacaaggacgtcagcgagatcatagaggtcgtctgtaacgcaggacttaccgccaaagtcgccaaactgacacccataggcgtcgtgaaagggtgaaccgaccctttcaaagacccaggaccttggatgtggccctggctacggcctccttcttgtcctctggacatgcgacgagcatagaccagctgaacgagtccctggattggagggctttggctatgggggatgtcctggtcagaggcctgaccttgccgtcctcccccactatggacacgtccgtcttgcctatctttatcttggcggatccgagattagccgaggacgtcatctccagaacgacctccgaaacatccaggccggccttgtccgctatgtgctgctccaactcgatcctcttgcgatggtccttgtatttcatgaggatgcgggacaattcctcatccacgtcccctgcggagacctcgagggctttcttgtagaacatgcggttctgtaccagcctcatcagacgggaggaactgcccccggccgatagaagcgcctgggtcatatcggaatcgtcccacaggtagatctccgaaagatccagatccgaagacaggacggccttggtgaccatcctctccaagaccctgaccgtctgatgatagtacacggacgagtacatcagggcacgcgataccatgagcccctcggcggccggggcccctccgcgctctatgcagatcctgtcgttgacgactctcatcgtagagagtaacctgtcgacgtctatgttgcccatgaccacaccggtgtagtgggcgtccctcatgagataatccatctggtccgcatccaccggaccgtggatgatctgatgtatgtaatccttggacgggaaatggtccatcccgtcgagtgtcagattgtcgagatcgcgctcggtgctctccggataggctatcaggtcgcagacctccaccggatctatcccgttactttcgaggatgtccgcgatggaaccggaacctgcaaggaggtctgcgtcacggtcgcggaagacctttccctttccgcatatgagattcctcgccaactccatatggtccaagcccgtggcatcctccatgacagcctcaagcgtgtgggagaatggtgcgtgacagatgtcatgcatcatggcggccgtcctgaccgcgagcgagtcctcctccgacagaccgatggccttcgccatcctgcctgccagataatacgtcccgagacaatgctcgaaacgcgtatggttggcaccggggaacacgaagttccccatacccagctgcttcacaccgcgtaacctctgcatctcgtgccggtccattatctcgaggaagaatccgtctacgcggatccctccgtggaccgggtcgtgcacggtcttcacgcggtcggacaactcactcgcctgccttccaaagcttgtcgccgacactgttcagcgacttgatggccttccccggctttttggccgccaattccgggccggaacgtgctgaaatcccgacggccaatggcactttgttcttcacatcccttatccatacgaaatccccttcctggatgctttcgtcggcctccactatgccggggcccatgcagtccgcaccgttggttatgaacggaaccgcacccatgtcgaccgtgacgaacctcttcacaggcttgtatttgatgacgcccctcacggtgaggaagaccttctcctgatagacgatcccgaggatgtcgttgcctacgataagaaggtcgaaatccgtgctttcggcacggtctaccggttcgttttccgaaaagacggggacgcccaactccgcctccaactggtccgagatggcctttacctctttgtttctgagcctcttccttttgcggatcctgacgtctgccataatatagaggcgtatgcgcaacctgaatagaaactttgggtacagaagtagccgacgcagacaaacgacctgaccgcccgcatcggctagacattgaaatcgcattgtagtatattactcttttttccgatgctggcacccgcatacggaactaccgtctgcacatgtagcgaagtcccggagtaataatgcgccggacggaccttggcgagacatccccgctgctggcacatgtatgtgcgagatggcgcagaccttctggaaacaagtaaaaatcccctatcagaacattctccgctagcataataacgatgtaccccatatccgcacatcatgggaatcaacatcgcattatgtgaaacggaagcccagaacgccccctgcagggagatgaagcttaccgttgtcaaagcgaaagtcgaagggaagaagttcgaaccgtatatggatgtagacgaggtcgtatccctcgaggatgccgcgaaggccgtcggcgatatggaagcgttcctcaaaaggaacaggatcaacgcagagacggacgctatatacatggacaaggtcaagaaggacgaagacaaggcgttgctggcacagtatgtgaagaaggttcccaccggatgggtggatctctccaagatggacgacgccacgaaggccgaggccctggaatccggagacaagaacgaccgcgtgaccgcctgggaccaggtggagttcgacgatatgaacgaaatgtgttccaaatgcgccctctcgtgggacaagggaaggggatgcatgggatcgttcggccccgagacgagccagctccccgcgatcgcacagaagtacgggtgccccatcatcggagccgtcttcgagaacgccaaagagatgaaaagactgagccccgaagacgccaaggccgtattgaacgaggtcgagatcctcaaacccgctctcgtcgaagaagggaaaatggcggtccacagatactccggaccgctggaaagaatcgaggccgtggcgaaggtgtcggtagaacagaactgcggattctacttcttctgaaaaaacaggtcgggagggggggggacataccctcccgaccatggacctcgagatcagttgctggcacccttcatcagaagggataccatgttctcgaccagcctggccatacccttcatggcctgctcgtcctcctcgtactgaggggaattgagggccctgaagataggcaggggataggtcccgacgacattgagctcattgtgtatgagccagtatgtcagctcgttgtatgcgttctcccctccgtcgtgggccgatacggtcagaacggccccggccttgcctctcagagcacggtcccccatagtaagtgccagacctgccctttccaagaagatcttcatggctcctggaacacctcccgcatatgcgggggcggcgagaacgacgccgtccgccgccctcatacggtccaggatgtcattcatgtcgtcatcctccatgatgcatcttccgtcccccctcatctcacaggaacggcagtcgttacacggctggaactcatggtcgtagagctggaccatctcggtctctatgccttccttctccaactcgtcgaggaactccgcgagaagattgcttgtgttccctataaggcgggaactcccgttcaaagcgattactttcatatcattcaacctccgggtcgatcttcggttccgcaccggtctctatggcatagagcagattgccctccccgtcgaagaaggatgtcgccacccccatcggcaacctcttgggatcgagtttgaatctgacgccctcgtcgatcatcctgcgatggaaatcgaaagtgtcgtccacccccaggaatatgcccgtgtctactccgaccctttccgaccgatagatcctgactatcgccgaccccctcctgacgacggcctcctccggcccactgtagaccacgtccatcatgaggacgtccctatagaatccgacggccgacggagggtccttcgatgggacgctcgccatgaatacggactcaggaagcccttctgtcgtatactggaaattacctccttgggggtcaccgattggcataggtccccccattacctcccaggttaagatacttggtcatgccggacaacacaaacactttatgagcacatgtgattcactggtatagaggaaatcgcaatggccgcaccagtacttagcgcagaacagatcgaggaggagaccagactcagggagaccctggccaacataaagcacgtcataatcgtactctcgggcaaaggcggagttggcaaatctaccgtatcgtccaacctggcagaggccctgtccatgtccgggttccaggtagggataatggatcttgacataaccggaccgaacattcccaagatgttccatgtggaagatgagaaactcctcgtggaaaacgacaagcttatacccgtacaggtccccccttccctcaaactcatgtccatggcattcctgctccccagcaaggatgacgcagtgatgtggagaggacccgtcaagatgggggcggtaagacagttcatagaggatgtcaactggggatccctagattatctcgtgatagacatgcctccggggaccggggacgaggctctgtccatcgtccaactgatcccgaaggccgatggtgccgtcatcgtcaccaccccgcaggacgtcgccctgttggactccaggaagtccgtcactttcgccgcccagaccggcatacctgtgatcgggatcgtcgagaacatgagcggattcgtctgtccccactgcggagagaccatcgacatcttcaagtcgggaggaggcgaggccactgcgaaggatatcggagtacagttcctcggaaaagtcccgctggaacccggagtggtcgcatccggagacaacggtatgcccattgtcgttgcgaaccccgagtcagcttccgccaaagccttccagaagatcgccgagaaggtcatcaagaccatcgagaacgagcagaaatacctcgaagaacagaggaagaaggcacaggagaagaaccaatgaaattcggagtcatctccgagggggaggggttggattccctcgtggccgaggatttcggccacgccccctgcttcctcatcgtggattccgacacgctcgactacaccgtcgtcgacaacgagtatgcaaacggagaaggtgccggatacaaagtcgccaaggccatcgtcgggcttggggtggatgttgtcatagtcggcggcatcgggacccatggcctcaagatccttcaggatgcaggcatccgcgtattctacgatatggacgacacggtggagaactgcatcaaggaagtgaaggaccgtctggaactcgaaaagaaattcgaatgaacgtctggcacatctcaaacgctttatgattttttacaaacatccatatttgtaagaagggggcgaatgccccctgttccatcacaccttccttctggccgccgccaggaccaatgccgcagaaagcgatatcatcactatggccgcacatacgctggcacatatggtcgatgtatcggggacgttcctctcatacgttatatccgcagagatcttggcatatgcggcggatgcggcatcataggtcttcaccacatccccgtgggaatatgcgtcagaatgcatgtaaggcatgaagtagctgatatcgctctgagcccaaagacgcacagaggtctcgcttgtggacgtttcgttgttgtcgacgtacccgtccaagagatattcctcaccatctactgatagccctatacggtcattgaagaaatgtatctgataggaacgtgtcacggtacagtcgtctccttgcgacaggtcttctgcagccgtatcgaacgcataatcaacataagagaaatactcgtatgcgatattcgagaagagccttatcgtcttggattcggaaccgtcggaggggatgaatgtaatgctgacgtcgaagtcctgcttctcgaagttgccatgtacattcctctctatggcgcagtattggtcatctacggcgacataatccgctgtatattccgaggaggattccagggacatgctgccttcgaagacgaacatatctccctcgctgaacacatccgtcccgaagtaggcggtcacggcatctgcgatagcgtcgccgtgataaccataactgtttggagagaacatcggtttctgatccgaatcactgtcgacggatactgtgatggataaccggtcgatactgtatgagagacaatatatgctgttgaaagtggagccgtagaaactcgtaccctgcgcttcgatacacgacagaccttggaaatcacattccagaatagcccttgagaaccaatccataggattgagcatggacgatatatcgatggccaggatcgtcttcggatcatccaaggcgcctaaaactcttccgagatcctcatcggtgaaatcatcgcctgactcgaaagcatatcctgcctcgccgtcactcccgtaagcggaaacatcctgtgaggaaaacagggccgaggatgtgatcgtcaataccacaacaagtgacgccaagaccgtcaagctgcgtttcatacatatcatgatgtataaagtcgaacagcgggataataaacttgtcatcgaccgcgacatgtaacaatggcccctacagaggatcagaccgtcaggtcgacatcatctgtgggatcatgacttcaagagtgccatacctcggacgtctggcacatcggatgtaccagattcacgataagtcccgatgatacgaagataaatgataacggtcccctagaaagggaccggacccttgggacgggtcaggatttcccggatccggactcccccttcggaatgtatccggaacgccgtccgtgaagggattctccgtatgtgcgccactcccttcgaacggcaacctatctgatccgcctatcgaagataatatctggcactgcatgtagcgatgctgaaaccttcgtttctactgtaacccatgattgccggagccgccgacccctgcggacggctgcccggcaaagatggtggggccccttcctgacggggccctttcatgtagagatatcagaccgaccaggtcctcttcctgagttcgtcctcggtaagaccggccaattcctggaccgtatccctcttcagacccattgcatcggcaagcctgtatccgtagtccggatccgccctgtagcaatgcgcagcatggcggtatttgatgttctcggtgactgcggccatatttcttgcggtattgtctatgagtgcatctttctccgccggcttcatgagcctgtacagatcaccgggctggcgatagacgtcatcctccctgtccaacgacggatcgtagcggtctatgtccccctctatggcaagggcaggttcgctgaccccgttctccttccactccccgtaactgttggggacataagacttcctggaaccgaaattgtcatccgtcctcatcataccgtcgcgatgataggagttgacaggacacttgggtgcattgaccggaatgaggttatgattcacaccgagcctgtacctctgtgcatccccgtatgcgaatatccttccctgcagaagcttgtccggggacagccccagaccaggcaccagattgacaggggtgaatgcagactgttcgacgtcgacgaaataattctccggattgcggttgagttccagctctccgacctcgatcagagggaactcgccgtggggccatactttggttatgtcgaagggattctccctatagttgcgggcctgctcttcggtcatcacctggatatacatggtccatttcggatactcccctctttcgatggcgtcgaaaaggtcgtgctggttgctctccctgtcctttccgatgacctcctccgcctccgcatcggtcagattctttattccctgctgggtcttcagatggtacttgacccatgtgcgctcgccgtcagcgttgatcatgctgtatgtgtggctcccgaatccatgcatatgtctgtatgagtatgggatgccgcggtccgacatcacgatggttacctgatgcagggcttccgggatcatggtccaaaagtcccagttgttctgagcggacctcatgttggtcttagggtcccttttgacggcgtggttgaggtcggggaacaaaagagggtcccttataaagaacacaggagtgttgttcccgacgaggtcccagttcccgtcctcggtgtagaatttgatggcgaaacccctgatgtcgcgctcggcatcggcggcccctctctccccggccacggtggagaatctgacgaatacctcagtctccttcccgacctccgagaacagtttcgccttggtgtagcgggttatgtcgtgggtgacggtgaactttccgaatgcaccggaacccttggcatgcatacgtctctcggggatcacttcgcgatcgaaatgacccagtttttccaagaaccatacgtcctgtaacatcatcggtccgcgggggcccgcagtcaaggagtgctctgtatcaggaacgggcgcaccattcttgctggtgagatttttgtcaggagacatatgatgttcgacgcggtctcggaagatatactcttctgcctacggctcggaatatgtgtaaagacttgcttaaaaaaatatgtcggacctatgatcgcatcatttcattccgcagagaatgggccctccggtcagacgcccttcctgtcgccccatattatcttgtggagctgaggaaggaccctgacgtcgagcttcctgtctacgacctcttccgccagcattccgaggctgacccctcctaccgggctgaatatcacgttggtgtccacaggatgttccctgaggaacgtctccgcatattccagatctgtacggtctgcgatgacgaatttgagctggtccttccgggacagatatgccagattggagatccgcacccggtcctgcatacctgaggaggggcatttcacgtccatacttatgatgatgttcggagaactcggaacgacggacaggtccatcgacccgttggtctcgaggaccgtcgtcttcccggcatcggcaagtctctgcagaaactccgcggcatccttctgatggaggggctcccctccggtgaagcagacgctcccgacatctccgatgatgtccatcagttcgtccacggacaggtccatcgtggcatcgctgtcgctgagggcataccccgtgtcgcaccaggaacatctcagattgcatccggcccctctgacgaaatatgtcagacggcccatctgcagaccttctccctgtatcgacaggaaatgctcgacgaccttcattgcacgactccgtcctcgtaggggatctcgtctttgtatccggcctgcctgaaaccttccagcctcaatctgcaggaatcacagtgcccgcaggctttctcaccgccgttgtagcatgaccatgtgagttcgagaggggctttcaattccttacccagccggacgatgtcagccttggagagatggaggaggggagtcattatcttgacaggatgtccctcgacgcccgccttcgtacccttagccaacatctcctcgtatgccttgaagaaatcgggacggtcgtccggatacccgctgtaatcgacggcattggcaccgatgtatacgcggtccgcatcgatggattcggcaagaccggcagctatgctgaggaacactatgttccttgctggcacataggttatgggaatgtcctcgtcgagctttccctccctgtccatagggacatctatgtccttcctggtcagagcggaacggaaggaggagaggttgagatctatgacgacatgggccaccccgtagtgtttgcagacgttctctgcggaaacgagctccttcgtatgtttctgtccgtaacggaaactgatggcggtcggttcgcatccgtcggcgatggcctgtgccaatgtagtggtggaatccaatcctccggaaagaaggacgactgctttcggcctcattgcaggatcaccgtgtaccatgccgtctgtccgcgctcctcatccaacccgacggatagggaccgcacattctccgggatcttgatttcattgaccagtttctccgccatcatcttggacatctcctccgccgtggtggtggggacgtcgagcatcctcacatccatacgggggaacatgtacttctttccgcagttgtccacgaggacggaatcctcttctgcggtgatctttacgatctcggatctggcaggcagaaggacggcatggtccatctcgtcgatcatctccttgagcttcttcttgaggacgacgaaatccattatcatgccgttctcgcctatctcgccttccagcctcaggcgcacgatgtagctgtgaccgtgcagcctggaacatttctcgtgctgagggatgaaatggcatgcggagaaccttatccccgcataccccccgtctatctccagcgtactcaatgtctcatccccgcaagcttcatggccaggattatggagtcggtgaaatcggtcttcaccctggaagtatccacgaacaccttgtccccgttgaggaccggggctccgagggcggtcacgttgccgatgaagtgcatgacccggaagatcaggttaccggcgataccgtcgggcgctatcactatgtccgcgtcctcgacgacatcctctatgaggatctgggcgtgatatgcgtcgtatcctttcctgttgagttgtctgactacttccaaagcatccgtgatcgtcttgtcgacgacgtcgttcctgccgatatcgtcgctcctcccgccggacatgaccgcgatcctctgactgggaagacccatgtccttcatgagtgcggcccctttctcggccatctagactttgtcttccacggtccacccctcgtcgataccgaccggggccatgaggaacaccctccccctgtaatccatgaggacggccctctggaggtcgtccacaccgagggcgttcttgataagaggcagaagtttggaggaggacatgtccccgcggaccgcggcatctatgaccccgttgctgagatcgtcggccagtttctgcgggtcgctgtatatgacgacgttggggttgtccatcacacgtacgctcgtctcgacgaatttagactcgggagcacagcctattccgaccttgacgtcgggaagcctaccgcccagaaattcatcagatgttaccatggtgcaactcattgattctctgtatttaaaattatgaatggcaccaagaaaaggtcagatggaatcgaagacgtagtcgtcccatgtccttttccccagtacaatctccgcttcggggatcgtcagcatgggatgggcatacctgacggaatcgtccatggctatcctgggacatgccgtgttgacgtatgcatccaccttgaacggtatgagggtctgcggtgacacctcgtccgttaccagcgtgtagacctctttgccagcctctctcagaaggcgggatatcctctccgcctccgtcggacgatactgtccgatcttgccgcatacgatgaccagatatttctcggcaggtctcgcgagctctatggcggcgaatctcctccggaggatcctgtccttcacgtcatccacgcttctgacctcgccggttatcggattgaggatcaccaccttcctttccaccccgaaagtggcggcgagcggatggaaatccccctctccgaggaagagatagcaacccacctcatcctgcacggcgacggccgcggaacagttgcacccgaggacctgccccggatagcagatacgggagtcgcctctgcccacgaacaccgtcttgccctcggattcgaggatctccttcgccttggatatgagaccgacgtactgcacggaggccagaagacctatcctggagggcaatgtgccagcaaccctcttcacggattcggcgatatccacctcggcacgggcctccacatacatcacatccgggtcctgaggcagattcggtatgggggaatgcccgaaatggatgagtccctgcgcataattcttatagcttgtaaaaagatcgcaggccccgtaacacggataacccagaataactgctgttgcgcctgtatctttaaaaatacggtcggagagctcggtggcgcgtatcttgagtccctccggaagctggagggcgacagaggtgaaacccctgccgcgtatccagctttcgatgtcttcgatctggagatcgaacatcagcgaatgaattcctgacctttctcgacgtcgatgtagcaggtggaggggatcttcatggatgctctccagagagcgtccttggcctggttgaccttgtctgcgttgacgtagacggtgtagacggcctggtttccctcgacccttgctgcggttccgacggtcttaccgaatgcacggcgcattccgctcgacacacggtccgctcctgcgccggtagcgagcttgttctcgcggaggacgacgtgggggtagacccttaccttgaagtggtagtcggtcgctccgatcttggtcaacaccctgttcgcggcgatacgtcctgcctcgatagcggtgtgcctgatctggacacgtgcttttaccctgagggtgagtttgacggggaactcgtcctccttctggaggtttcccatgtcgaactggctgatcctgacggacgggacaccgcccatatactcgcggcgagtataggccattcccgtgatccttctatacatcgatgctggctttcttaccattgatgccacctgttattgttaaatggagcgtgaatctccaatctctatttaaccccttggtagggattgactaattgttccgataggcacaaacaatataagggttacgttggaaaagaccatttttccttatatatcgcatatattaagggccctatcacatcagttttatatgagtcctgcagtgggagtcgcgatcagcatggccaagcatcttacccgttctgccgtaaggaaaatcggcgccgaacgcgtcgggatcctcctaggattgtcccaggaggcggtaagggaaggtaaggacgaccgtgccgtgcgttatgtcgagctcgcccgcgcgatatgcgggaaggctcagatggagatgcccagggaattcaggttctgtaaggattgccttctgccgctggtcccgggcaccaactgcacggtcagactgacagggcataagatagtctccgaatgccggagatgcggagccgtatggcgcatgccgtatctgaaagagcagaggggatcctgcgggaccgcctccgcggaagacgaagaggaataaacatgaccgagagggaagcgaagaaggagctgcttagacgcgccaaggatatcgacgctaccgtccgtgtaggaaaggacggcgtaaccgagagtctcaacaacgagatcgttgagcaattgaagaagaaacgcctgataaaggtcaaggtcctcaacaattcggactcggacaccaaggatgtggccgagcagattaccacggcgaccggatcggtagcggtggacgtacgcggaggcgtcatccttctggccgacaagaggacttgggactccatgtgccagaagaaattcgattgaaggtgattctagatgttggacatcgacgttatcagggccgatcccgagaagataagggacatgctcataaagaggaacaagaccaccgagaggctcgacaggcttctggaggccgacggcgagtggaggaaactcaccaacgagaacaaccagctcagaaagaccaggaacgccgtctccctggagatcgggaagatgcctaagggtgcggagaaggacgccaagatcaaggagatgcgcggggtcggagaccagatcgccgccaacgacgccaggatggccgagctcgatgccatcaggaaggactgcctcctcaacatacccaacatacccgctgacgacgtccccgtaggaaaggacgacaccgagaatgtggaggtcaaggtctggggggagaagaggaagttcgacttcaccccgaagaaccacgcccagctcatgttggacctcgacatggtggatttcgacagggcgaccaagatcgccgggtccggattctactgccttaaaggggacggtgcaaggctcgagagggccctgatctgcttcttcctagacatgcacaggaagcagggatacaaggaggtcttcacccctgtcatagtcaacaccgccgctgtcaccggtaccggccagtaccccaacctgaaggacgatatgtaccacctcgagagggacgacatgtggctcaaccccaccgccgaggtccctgtcaccaacctcctccagggcgacatcctttccaaggaggacctccctgtgaagctgaccgcatacctgccttccttcagaagagaggtcggaaagcacgccgacacagccgggatcatccgcgtccatgagttcaacaaggtcgagatggtcaggttcgaggagccttccaagtcctgggaggcgctcgaggagatgaggggcaacgcggaagagctcctgcagctgctgggtcttccctatcatgtgctcctcctgtgcacaggcgaccagagcttctcctgcgccaaatgctatgacctcgaagtatgggcccccggagaggggaggtatctggaatgctcctcctgctccaacgacctcgacttccaggccagaagggccatgatcaaatacaggcctgagccccacctcaagagcgagttcgtccacaccctcaacggttccggattggcacttccgaggaccatggtggccgttctggagaactaccagaacgcagacgggtcggtcacgatccccgaagtcctgagaccgtacatgggcggacaggagaagatcgtcccgcccgagacgaagaaaactttctgaacccgcagagggggcgactccccctctggcacaattactccgaacgctccgcacggccgtccgtgtagacgcgttcggaccccattctcccgcggatctcctccaatatggacgtcagacttgcacggtcgactatctcctccgacagtctgttgcggtattccctgcaccgatggcatccggcgatgaatctgggagcataactgcggagcttcctgaaggccgtgtcctcccccttctcggctatgagcatatccgcgaactccagacaccagtcgacctgctgggacaccgtagggttgggaaggacctcgcccgtcctgaaataacggtcgatctgggtcacgaggaagggattgcccacccctccgcgggcgaccatcacggcctcggcaccggtgatacgggcggctgcggccgcatcctccacggtatagatgttgcccgagattatcaatgggaccgacatctcggaacggagtccctccaccatgtcgtaatgaggcgtccccgcatagcgctcctccttggtacgtacgtgaagggatatggcatcgacatcggccgcggtaagttcttccatcacctgcctgaaattgatagtgccagaactccaacccagacgtatcttggccgttaccgggacgccggtcgcggccttgacgcgccggattatctccccgcatttggccggatctttcatgagggcggaaccggatccgttacgaacgaccttcgcaacggggcatcccatgtttatgtcgaagaaatctatatccggattgatcctcagggattccgcggccgcttcggccagattatccgggtcattgccgaatagctgtacgccggtcggatggttgtctttgaatgcgatgtatgggacggtccttctgagtccgtggatgacccccatgtcggatgtcatctcggtcacggaaacggccactccgaaaggcttcatgaaatcacggtagctttccgaggtgaacccggacatcggtccgagaaccacacggccatcgatggcgatatcgcctatcttccacatcgggacggacgataccgttcttggatattgtgtttgtcccgggatcagatctccatcttctcgaaatcggctattatgtcgaatgcatctatggtctccccatagcctccgaccgccgtcagcttcctgcctatatccaccttcccgtccctcagggatttggaggatacgccgtaacatatcgatatgtgcgcctccatccaggcggcgagccagtcgcacgcctttatctccttcccgttgcgtctggggagatccgagtcggagaaggggtcgtacgccatgaacctcaattcttcacgccacccggcggggatcaggggcattatcctcttctccatcatctcatgctctatcccctccagaaggtctggaaggccggagacggatgtctttacgggggtgatcacgtccttcgtgaggacctccggcaggtcgtggaacaaggcggtgtagaaatcgttgtagacctgttccccctccactccgcagtcgcagtcgttcagatacaccatgtcggccaccaggagggaatgacccagcaccgtggtcttgggtatcctgggggtcctcgcccacctctgctggaacctcagctgcccgacgatgtctatgaaattgtccagatcggagcgtttggtcatcaggtccctgacgcctgccaggtcggaatgctgtccgatctgtccgtcgatctcttttttagtatcctcgataccgtatacggacctgttcacctcgtatatggtgtcgaactcccatttggtagcaagataatgggccgcacggatcacggcatcctccttggacgacctgtccgagtacagatattcctcgaaccgcttcctgaaaccctcatccgtatgggggacgctgcggtcgaattcgcataggacgtatctgctgacatcgtccgccttctcctcctctatcctatggaagacctgcggcttgaggtctgtgagggcgatcctctggatgaaggagaacaggttgtgctcgatcagcctgtgccagtcgatggcggccccggcatcctcttcgcatttcccgagcacccacgctatggcggtcttgtgggcctgtttgtccatctcggacaggtccagcgtgcggagatggtcgttccacctatgcatgttggtcgagtcgaaaagatagtacagcatattggcgttcaacgctttcccgttcatcccccgtcacttccttttgatgccgtctgtctccgggagggtcggattcttttctcttccgtccccatccgacgtattgtcaccgtccggacggtcgacgggacaccctgcgatgtccatctcacctgcagacagatattccttttcctccgccacctcctcacctgcgatatccagatccagacgcaatatgcgaccctccttacagggcgtatcgcgatcgacgccggcaggcgaagtgtccaacggggctccggcgatatcgacctccgtaccgcagaagaccttttcccgggatggttccgtcttcccgccgacggtgaggtcgtcgatcggagggaggtcggccggcatgtgtctgcaatcgtctgcggcgaggtctatgacatacccgtcatccagcacggaggacagattctcctctaggaaacagtcgtaatcgtaatcgtcgatcgcggcctcgttgtccttcctgtccttgtagaagagaattatcccaaagaacaccaagacgtaccccgcaaacacggcctgaccggggagggggtgtccatgatccccgtatagtcgagcatgccgaccactgacaggaccattcccgaaagaagcaggatgatgcaatagtcggtctgctctaatctcatcgccctccccataacatgagcggactattaaatgtggctaccggaacagattcaaataactccgaatggatggtgcgcctgagcgaccccatgtgcgacggaatatgcctgttctgcgggaaaggactgcagacgtatgaaagacccagacgttcgacgtgttcggtatgcggagaggaattcgaaccctccgcggcatgtcctgacggtcaccatgtgtgcgacggatgtctccgcgaaagaggcatcagcgtcatgacggccgtctgcaaaacgacggattgccgtgaccctgcggagatactcgaccgcctgatgtccatccctgcgatacctatgcacggtccggcacaccacatcctggtcggctccgcactgctcgcggcctacaggaacaatggcggaaagaccgatctggacgcgtcgatacccgaattgatcagaagaatgtcccaggtgcccggagcggtgtgcggaaactggggatgttgcggtgcggcactgagtgcaggtacgttcgccagcatcgtcctcggctcgggaccgttggagaaggatgtctggaggatcccgatgaggatgaccgcctcctgtctggaaaggatatcctcgtacggaggacccaggtgctgcaagagggactcgttccttgccatagaggccgctgcggatctcataaagaaggagacgggggtcgccatggatatccggaaaaggatcgtatgcagaagatccggcatgaaccaacaatgcatcggaaaggcctgtccctataacggaaagacggcctgcgacatgcctcccatacttcccttatgaaccgccgaccgcctgatatcctgccgatcgtttgaaaactattataggtgccacgcatactgtccgattatgaccaatggtatgaaggtgtccgacaggctcgccgccatcccgatgtccgggatcaggaagatgttcgaccttgccaaaccggactccatcaacctcgggctcggagagcccgacctggaacccccgaaggaagcgatagagggcatgaacgccgccgccgtggacgggaagaacaagtactcccccactgcaggcatccccgaactgagggatgccatagcggagagattctccagatacaaccccggactcagcggaaggaacgtcatagtcaccccgagcggctccaccgccctccttgagatgacccaggcgttcgtggatccgggggacgaggtcctcgttcccagtcccgggttcgtcatatatgctccgcatgcgagccttgccggcggaaaacccgtcgaatacagactgacggaaggagacttccagccggacatcgactacatccaggacaggatcacggagaagaccaagatgatcgtggtcaacaacccctccaatccgacgggaggggtcctctcggaagagtcccgcaaggccctggccgacatagcccatgacaaggatgtcatgatcatgtccgacgaggtctacgagtcgttcgtctacgaaggaaggcaccagtcgttcctgccttatctcgacagggccgtggtggtgggaggattctccaagatgatggccgtcaccggatggcgcctcggattcgccatagccaacgaggagtgcatggatgcactcgtcaagatgcaataccatgtatgtgccagtcccggaatgcccgccatgtatggagtactgaacgccatgccctccatagacccgtatctggagaatgcacgggccacgttcaagaagagacgcgacctgatatccaagaggatcaacgagatcgacggcatgagcataatcccgcccaaaggggcgttctatgcgttcccgtccttcgacctcgatatgacgtcgcaggaactcgccaacgaactggtgaaggcgggactcatctgcaccccgggatcggccttcggaacgttcggggaaggacacctcagattctcctatgcggccagcgaggagaagatagacaaggggatggacattctggccgacaccgtaaggaagatcaaaggaggaaggatatgagcggagaacttgacccgaacgccatgctgttcggcggagaagaggatgggaagacggaagaagaaagggccgtggaatacgtctacgggaagaaccccaacagggtcagcgccctcaacgacctgtggttcgacgaacttctcaaaaaaatagaatccctggacctccccgatgagaaggccaagataaagatggcgttcaaactcacggccggcgccgtactcgacatgttggccgactcccagcctcccgaggccgctcccgacgtcatgtccgacttcgacatattcatgggtgtcgccctcaccaacaagaagttcaacgtgagcctcttcgaggaacagcagaaggccctgatgcagatcgacagagagaaattccacgacgacgaggaatacgcccgtgcactctcagacttcgaggacacgtggtgggaaatcggtcagcccctcctcaacggaaggaatccgaacgatgccatcaaagagacccttaagaaatacggactgaacgaggaatgacgaccatatccgcatccgcacccggcaagttcgtcatactgggcgaacatgccgtggtctacggcaaaccggcccttgccttggccatcgacatgcgcttcagcatacgtgtcagccgcagcaacagttacaaggtcaacggacaggccgccaccccatacaacatgagtccccatatgaggtacatctcggataagatagggacttcccccgtatccatatatgtggacgggagggttccgtcgggatcaggtctggggtcgtccgccgcactctccaatgcatatgcggcggccataagcgcactcgaaggactgcctacggacaaggagaccatagccagactcgcatacgaggccgaatacgcctcgcaaggcaggggcagccccatggacacgtccgcatccgccaacggatacggaatcgccctgaacgtcccttacaaggaagaggacttcctctggcacatcgagaaagaagataatgcctgggacatatccaagatagacgtccccaagatgacgttcgtcatcggcaacaccgggatcaaggccgccaccggccctctggtggaaaaagtcagaaaatacagggagagcaacacattcgccgcaggcatagtcgacgagataggtgatgtgaccctcgacggactcgaggccatgaagaataacgacctggaggaactcggtgccctcatgacctacgaccacaagctcctgtccatcctcggagtatcctgcaacgaactcaaccatatggtggaagctgccataccgtactcctacggggcgaaactcaccggctccggcggaggaggatgcatggtcgccctgaccgacagacccgagaaggtcgcaaaggccataagggcccacggagggaccccgtatgtcatccatacgggtgtgaagggtgtgaccgtgaagacgaaggagcacagcgaccatcgccgcggcggcagaaagagatccaagagcaatccctccgaagacgaagaggattgaacatctgggtcttttttattcctttgggatcttaaaataaaagggggccgaaggcccctgaaatgtttttctcagatgaggtcctcgaagtccttgacgagctccgggaacttctctttgatgacgatgagaaggttctgcacgttgacgtgctctatatccgcggtggacatgatcttcacgagctcgttgatggtctcgtcatcaagctcgcagagcttctctttggccatccagtcgcggtagagtccgtcctccatgcggttgcggatcttcttgtcgtacgccttgagtgcggctgcggagtaatctcccttcttcttgcactcggcgagtacctctcccgcatacataccagagacgcatgcatggccgataccgccgccggtgagcgggtcgataagccttgcggagtctccgaccaacaggacgttgtcggtggaatagccgccctccagaccggggcaggtggaatcgaagcctgcatcgatctcgaggatctgcgcatgcttgaacctggggtcctcggcgatgaacttgtcgaggaactgcttcgggcggacgccgtccttggcgaaggtaccggcgataccgatacctacgttggcgacaccgtctcccttggggaatatccaaaggtatcctccgggagcgacggacctgccgaggatgaactcgcagaaatccatggagcattcgcagcccgccatcctgtactggatgcagggctcgatgtcgttgagcttgaggttcgtgtcgataccgcaccagcggccgacctgggactcgataccatcggctccgactatgcagtcgcaatagatgtccagaggctcgcccatggacatgcagtgcgctcccacgatcttgccgtcctcctttatggggccggtcatccaggtgcgcaggtagagcttggcccccgcctcggcggcgagcttgctgatacctttgtcgaacagatgcctctcgaggacgtaaccgacctcggccccggccttggactcgtccagctggaacgaggtcccgtcgggggacctgatgaccgcacctttcatatcggcacggatccactcgggcttaggctccacaccgatctccttgaacatcttcttggagacaccctcggcgcacctgagaggcgctccgatctcgggcttcttctcgatgaggatggtgtcgatacccttctcggcacagctcttcgccgccatgcctccggcgggaccggctccgacgacgaggacctcgcatttcagggtgttcattgctttccctccatggatatggcgccgacggggcagagccttacgcatctgccgcacctgttgcaatcatcgttgaatgtcaggatggtgtcgcacaggaagatcgcattcttcgggcagcatccgacgcaaccgccgcagtgcaggcatttgttggtgttgactatcataggggttcactccttgttctcttcatccgcgtccttggggacgatgagggcggcctcgagctgtttggcctcctccttgtgcttctccttccactcggcgagcgggacggagaacttcttctcggtctctacacgcatctcgataccgctgttgtaggcacagaacggaatgatcttgcagtcgggggtgacgtagtggatggaacagcgcctgaccctctcgatgtcgtagttgaaggaatcctggaagtgcatggccccgacgtacatcattccccaggagaacttcgcaagggtggatttggacttcttgctcatgatggagatgagagtctcgatgaggtcgttcttggtcatccctccgggcatcttctcttcgataaggcagttcatgaggagcttcctgaccttgagggcggtgagcttcttgaaggtcgcatgctccgccttcatggcgatctcgtcgagtcccttgacgaactgttcgaccttgatgaactcgggcatcgggaacacgttctcgttctcgtcgatgaacagatacgtggcgagaccgcagtgggggtgggtcgggaaggtgatcttgttcgtgccgaggatgatggacgcgtagttggatatcccggatacgacgggcacggggtaccagtcctgcatgccggtccatccggtctgctcgttgacggccttggcgacgtcggtaagggtgatcctgccttcgctgacctcctcgtgggtgacccttccggtgaaggcgacgggctggaagttgacccctctgacgacgtccctgttctggatggcgaacctcaggatgtcgccgatctgattgtcgttgaggccgcggacggtggtgacgacgaggacgacggacgggcagtgtccggtctcctgcttgagcttcttcaggttggcgatgacgcctttcttgacatccatcatcttccttccgcgggaacgcatgtagatgtcgtcgtccatgccgtcgaactgcaggtatacggtgttgagaccggcctgggcgcactccttgagcttgtcgtaatgggatgcgaacacgatcccgttggtggctatctgcacctgtgcgaacttcctctcctttgccgccttgatgacgtcgacgagtctggggtagacggtgggctcaccgccggagaactggactgcagtacacttgatgggctgctcgccacggagggcgtcgagcatcttgcagacggtatcgaaatccggctcgtagacgtatcccgcatcgttcgcattggcgaaacagatgggacagttcatgttgcacctgttggtgaggtcgatgttcgccaatgcggtaggggagagcatctccaccttctcgccgtcgatgacgacgttgacgttctctccgtccttcaggttctcgtccatggagttcttcagtccggtcccgtccttggcgtacttctccgcctcgagatatttggcagcatcggaccaatatacatcgcagaactttccgtgctcggggcactccttctccatgaagactttcccatccttctcgaagatggtggcttccaggatcttgccgcactcgggacagatcgacttggtcttcttgggaagacctgtggccgccgagtagggcttaactgttgcgcacataagggctggaatttatctttgtattaaaatactgttgggttagattggatgggtcttccgtgttgtaatacgacagtaagcactacatgcagtatctgggttttttatccgttcccggcgagatcgtcggcatggttcaacgtcctgggaagataaggagcgggagagaagggagcctgcctttcgcactgatagcagtggccatcctgataggggcctcggcatactgcgcggtggcggcgggtgtggacgatgcggggagacgcacggacaacgcagagtcggagatggaccgcgtatccgaggcgatctccgggatcaccgggttcatagaacgcggaatgggggagaacgtgttctgcgtaagcaccgacgtgtccctcggagacatgacccagcgctcggaggtgttcgagaagaggatgtcctcgtggatggatacgatgttccctgccgaggattcgggggtgagggtgaccatgcagtcctacgagatagggctggaggtgcaggacctcaggatgtcttccggatactatgccgccgacggttacgtcccggcgttcatcaaggcccaaggcaccgtggaggcggtgttcgaatccgaatccgggacatcccacaggaccttgtatgtcgtatcggacgggagcggggccctgccgctgtcgtccgaggccggcaccatgttcgagaacatcctggaagacgggggatccgtactgtcccagatggtgtcgtaccagctcacggccctcgcccaataccgcataatgaacggttacggtgcattcgcatactacggcgactacggaacggactcggtcatcacagaggacgacgtcaggggtgcgtattcccgggccctccgtgcggtggaatccatcgtattcagggacgccgacggcggactgatgaccggcagggccgatctggccaaagcgatagtcggcgatgcggaaggaaggatgcaggtcaacgtgagcgcggtctacgcccaggccctggccgcggtggcggacgggatcgtcgggaagtggttcgactacttcctgggcaacaaggtcctgcgcctatgcgactacgtggacgacacccttaggaacgcctgggactctttcacgtcgttcataacgggtaggaactcgttctctgcggaaccgtacatcgaagagatagtcggggacacggacctgggcgtgggacggtacatatcgatgacgataccgccgatggacgggacggacgcacccccgctcaccgtatatctggactgtccggagcacgacctcatgggatcggatacggtccagaacttcaagtcgtactaccgtgacgacagcaacgcgatccgcgaatggctgtattccgtcgtgaacgaatcgatagcccaggcggcggagaggaagttcaccgggactgtcgtcgtggacttggacgactcccgcaggttctcggaggtcctgtacgatgcggtgacgcaggccatggacggagcgtccgacgcattcgcatcctccatggcggacaccgtgggctggcactcgtatccggaccagttctacgccgccatatacgacgccgtatacagggacagggagaccatattccatacggattacggggagttcagggagaagaacagggacacggtgttccaagcggtactcggccactgcgagaattatgccgagaaccgtgacgacgcgttggactatgcggagaggatgtgcgaggaggccttcgacatccaatggaacaaggaccgcttcgacgaatacgtcgcggccgtggacgccctgatggataaaatggaggcactgaaaagcgtacagtcgaagaagagcagcatcatcgagaaagggtgtatcggaatcctcaggggagggatgctgaaggccgacggggccttcgacgtatccggacatctggcacagatatgttccatgttctccgagaacatcgggatcaacgccgcggagggatttaccgaccttcccgacagaagcgacttcgtcctgaccggggacggcgtctcgacggagaggctgaagatatcggtcgtctcggacccggatgcatccgtcggcagaccgaagacggccgattgcacacaccagaacggcctggaagatgcctcgggggccaactactgcaccgtattccccgtacatctggatgacagggtggagtacaccgtgacgagctgcggggccctgtcggaactgctgggtatatcggattcggtggtcaccgggacctcgtatgtgtccatggacctggacatagccgcagtatcgggatggggcctggcaggggtcgactacgaggcttcggcggacatcctccacgacctgtggagacagctcctgaaggccgcggaaccgcttctggaacccctcaggaaggcactgtgcctggccggcaagacggcggaggccctctggaacgtgatgacggagatctccagatacgccgccagctatgtcgaggaactgtacgagaagataatcgcccctctggagaccctcgtatcctgcataaaggagagggtgaacgaagtcctcggagagaaactctacgaggtggccgacgggttgagcgccatagtggacatgaccctgaagacccagacgatcggattctcgtacatggggttcgttttgaaattcacgacggactgcgcctccctgtccaaatccaccaagaacctcctgaaggtcgagatgtccggaaacgtcggaggggacgacgtctatgcatatctcgacatcaagctccgcgagaaaacccccaagaccgtggtcacgggaggaatagccgtggagggggacgggtggaaggtctccgggacggtggaccccacgatgacccagaccaagcatctgttcaccctgtccggcacgttcagggggacggctgtggacctcgtgatgccggaacttgtccaataccgcgagatcgacatcaggctgtcggacataccgggcatcgggaccgtcctgtccaacataccctcccccatagccggtaccaagatcgctttggatgtgggcctggacataaagtactctgcccccttcgagacgggggtactcatcaacgagatcgagagcaatcccgaaggggacgatgtggacaacgagtgggtggagatcatcaacaacaccgcggccaccgtggacctctccggatggatgctgacgaccgggagagggagggcatacctcatagagagtgcggaactgcctcccggaggaagatacgtcgcagaattcgaggggatattcctgaacaacagcaacgaacgcctgatcctgatggacagggacaaaaagatcgtggacgagatcagcagattctccgacagggacaacgactccaagacataccagagggcggcagactgctccaccgaatggggcatgtacgagggcagcaaaggaaccggcaatacgagcgggacgttcggaaaggacggcatcttcatgaaggacgtggccgacatcatgaagaatgccgccaagagggccatgggggaactgaagcatgttacggacgtcggaggcctgtccgacctgttcacccgcataatgcaatatgctctcgacgacgggatagacagactctcctcctgcctggtggaggcgtccgtattcgtcagtgtggagatacaggacatcaccgggacaggatgcaccggattcgaggtctacgtgaaggcggggaaggaaatggcggaggatgcgctgaaatatctcgtcggcagggcggaatccatgctcctggatatcgaggacccttacggggtcgacctcgggacggccgcctgcgacgacatctatctcggggtgacggcttacacggggactgcccctcccaagttcctgccgtcgtccaccatcgtcagggatgtgaccgtcggactggatgtcgcatgcaacgtctccgcggtgagatccgtcctcggagacgagggggacggtacatggaacatgcgcgcaggggtcgtcatacgcggatgcccgaacggcctcatcccgtccggactcggtgccgacgaaaccatggactccgacctttggctcatgagggtatccgtcggtccgagctgagaggaccgggggaagtacatgggatcccctcccccgcaggcccggcacccatccctttaattacgcgattacaatgcggaaagcatggccggaatgaacacaactataccgacggtcctctcatcggaggaattgatggacaaggcattccgcagggcctccaagatcagcaagaaaggcagcgactccttggacaccaagaagaagacgacgctcgccaggatcacggcttcgggcgacatagtcgagacgactctcgtcggctacatccagaagttcccgaggatggagaagcaggacgatttcttcccccagctcgtggacctcgtaatcgggatcgaccgttacaagaaggcgctgggtgccctgaactgggcggccggaaggaccgaactcctgaagaaccagtctctcagggaggtcagacggaccaaggaccctgcgatcatcgaatccataaagaagggattctacggacgcctcggatcatacgtcaaccagatctcgaaggacctgcttttcctgcaggatgccaagaacaagttcagggaccttccaaccatcgacccgaaggtccccactgcggtggtcgcaggattcccgaacgtcgggaagagcagccttgtgacctacatcagtaccgccgcccccgagatagccccctatccgttcaccacgaaggggatcaccatcgggcacatcaaggacgactggaggatgttccagatcgtcgatacgcccggactcctggaccgcgatttcgaagacaggaacgacatcgagaaacaggcggtccttgcactgagatacctcacggatatcatgatcttcatcctcgacccctcggagacatgcggatacgacatggggaagcagacgaaactcctggagaatatcagggctaatttcgaaggggtgccgatcgtcgtcatagagagcaagtgcgacgtcatgcgtaccgacaaggaggtcatgcgcatatcctccgtcaccggggaagggatggaggagctgaagacccagctcgtggaaagactcaggaccgtactcagacagagggcgttggagacgccgctggaagaggtagagtgagatgggagaggtcgcaacaagcgacgagatgaaggcttatttcaaaaagctcgaagacggggcggaggagatctaccagatcgccgccaaggcccgcgccgaggggaaggaccccactctggaagtggagatcccccgtgcggaggacctcgcatcccgtgtcgagaagctcctttccgactaccatgtggagggtgtcgcggaactgatccgccagaagacggcggagttcgggaaccgcgagatcgtcgccatcaaggtggccgaggaatatgccaggaaaggcatagagaacaacgaaagcaaggataagaccctggaccgcgccgtaaggctcggtctggccatcatcaccgagggtatcctcgtcgcgcccctggagggcatagcgaccaccaagataggacataattcggacggtaccgacttcgccgacctcgtattcgccggacccatccgcgcttccggaggtacgggacaggccatgagcgtcctcatatgcgacgtggtccgtcaggccttgggcatcggcaaatacatcccgaccgaaggggagatcgccagattcgacgaggagatccccctgtacaaacagtgccagcaccttcagttcacccctacgtcggaggagataaggaccatcgtcagcgagtgccccgtcatggtcgacggagaagggaccgagcagacggagatatccggattcagagacctcccccgcatagagaccaacagggtgaggggaggggcatgtctggtcgtcgccgaaggtatgtgcctcaaggcatccaaactgaagaagcacgtggacaaactgggcataaaaggatgggaattcatcggcaaatacctggacatgcacaaggccgtggacaccgacgacaagaacaagaagaaggtcgtcgagcctgcgtacaagtatctcaaggacatggtggcggggcgcccgatattcggacacccctgccgtgtcggagggttcagactgcgctacggaagagccaggacatccggtctggcatccctggcatacaatcccgccagcatgtacgccatggacgaattcatggccatagggacgcagttgaagatcgaaagaccggggaaggcgtgcgtcgtcaccccggtggacaccatagaaggacctacagtcctcttgaagaacggagacctcgtgtattgcgggaccaaggaggagtatctgaaggtcaaggcggccgtggccgaggtcgtcgataacggggagatactcatcccctacggagagttctgcgagaacaaccacgtcctggtcccctcgggataccccttggaatggcatcgcgaagagatcctggccaaaaacgacgatgtactcccggacgactggaaggaccccacttatgcccgctccaaggagatgtcggctcagttgggcgtcgcactgcacccgaaattcaacctatactggtccgatgtggaggtggagagactttcccgcctccgcgatttcatagcagaggagggatgtgtctccgaaggcagcatctgcgtacctctcgacaggtctccggtcccacaggacgagaccaaggacacatccgtgaagaagatcctcgaagacctcggtgccctgcataaggtaaggggatccagagtgatcatcgaccctctgtacaccgaacctatgatcgactgtctgggtctttcatacgacgggaagaccgtctccaagagaggggagttcggaggagaagaccccctgagtgccgtcagcgccgccgccggatataaggtcatggcgagggccatgacccgcgtggggaccaggatgggacgtcccgagaaggccaaggaaagggccggatccccgttggtgcaggccctgttcgccttgggagaggtcgtggatgggaaggacaaccccgtaagggatacgacctccgccatcaaatcgctaagcgaccccaacctgcacaaggacaaacccgccagcgccctgcatgtggagatgggtgcccgccgctgccccgtatgcggtaaggagacctgcctctgctggtgcagggaatgcgacgcccataccatcccgtacgataaggccaaacctgcggacggcggttccgccaccgtcacagtagacatagtcaaggaatacagggatgccctgaaggccctgggagagaacgaagggaaggaatcgctcagatgcgaggacaaactgacctcccataccaagaccccggagttactcgagaaaggcatcctgagaaggaagcacgacatatccatcttcagggacgggaccatccgctacgatatgaccgatatcccgctgacacacttcaaaccgcgcgagatcggcctcgatatcgaaaaggctcacgaactgggatatacgcacgactggaacggaaacccccttacggaccccgaccagatcgtggaactgaagtgccaggacgtcatccctgcgaaagactgcggagattatatggcccgtgtcgccggattcatcgatgacgaactggagaagatataccaccttccgcgtttctacgatgccaaagacagacacgacctgatcgggaaactggtcttcggtctcgctccgcacacgtccggatgtatcctgtgcaggatcatcggatacagcagcgtacgcggatgctacggacatcctttctatcacgcctccaagagaaggaactgcgacggagacgaggactgcatcatcctggcactcgacgcattgctgaacttctcgaggatcttcctccccgacaggagaggaggactcatggattgcccgctggtcctcaccaccaggctggatcccaacgagatcgacaaagaggcccataacgtggactgcctcagggcgtaccccttggacctgtattatgcggccatggacatgaaggaccccaaggagatcgagaagaagatggacctggtaggaggccgcataggtactccttaccaatacgagggacttggattcacccatgacacgtacgacatatccgagggacccaaagagtccgcatacaccacgttggggtcgatgaccgataagatgacggcacagctggaactcggcatgaagtgccgtgcggtagatgccagggatgttgccatgaaggtcatcaacaaacacttcatgccggatatgatcggaaatctgaggagttttgctacacaaggtgtgagatgcgtcaaatgcggaaacaagtaccgcagggtcccgctgaaaggcgtatgcaaatgcggaaacaaactgaaccttaccgtacacgaggcatctgtcaggaagtacctcgaagtatcgaagaaggtctgcgagaaatacgacctcgacgattatacgaaacagaggatccagataatcgagacgagtatgaactcgctattcaacaacgataaagtcagaaaatgcaaactcacggatttcatgtgagattgcatctggcacatctgcatcctatgaaaaaggaatgccccggccgaatggccggagcttgaatgtgttttaggtttttccagcgacagtatcactgtgccagagcatcgacctgggcagagaactcgtcagcctcggccttcaggatctcgacggctttgtcgaggacctgcctggcggtaagggaaccgtcggtctcgaacttgaacaggaaattgttctcgttccaagtcaccttgatggcgcccttgggtatcggatcctgcatggcggtgcttccgaagttgacggccttccacttgtcggcaacgacaagctttccgtccttgacctcgaacagtccggggcagagctcagcggccttgagagtatcgggatcggatgccaaagccgggtctatctcgatgatgggctcgtaagagtatccgacaccgaatgcggcctgccatttgacatgcttcttcgcggtacccatgacggccgtcgcatagatcaggaccgcctggttgtcggtgagctcgacgaccgggatgaactcgtccttcaccttcagggtgttgtccccgagagggacgaggtcaccggaatagacggtgccgggcccgaccttgttgatgctgtacatgatggtgcagtgcgggcagccttcgccgccgcactcgcacttgtcctggaaagtgaactggtcgtagtcggtgggtacggggatcatcccgagcctgtgggcgattacctcgtcgaacagggaagtgacgctctcgtactctttgtcgtcctgcatgatgggaccgaggtggaactccaccttgtcgatcgccatctttgggatgtcctggatcatggtgcgcctgagtgcgttcgccattgcaggcgaggagttcttcaggatgaacttagccttcctgtcctccatctcgacaatctcgatctgcatgaccagtcctcctcagaccctgcgtcccctgcgtccacccttaggcttggtaccgtcgtgcggtatgggagtgacgtcctcgatgcgtccgatcttgagaccggcacgggcgagggcacggatggcggcctgagcaccgggtccgggagaggtggacctgtttcctccgggagcccttaccttgacgtggataccggtgatctctttctcggcggcgatctcggcgatcctctcggcggccttctgggccgcatagggcgaggactcgtccttcgcctgcttgacgatcattccaccggtgaccttcgccagggtctcggccccagtgatgtcggtgagggtgatcataatgttgttgtagctcgcgtagatgttagcgattccccattttgcagtcatcagttagcaccgtcctctacagtgattccggcctcttccgcgtcggccttagctgccgccgcatcctcggcctctgcccttgccctggcttcctctctggccgcctcgcgtgcttccgatccctgtccggaggccctcatggggtggttctcgtcggtgaacggggatgcggggttgtatgccacggagccctcctcttccctgaggacgaggtatccgggaacggtgaccttgtgtccgtccacgaagatgtgtccgtggttgatgagctgccttgcctgcctgatggtggtggcgagtcccttctggaacacgacggtctgcagacgcctgctgaggatgtcttcgtccttcaggacgaggatcatgttgaggtcccctccggtgacggggaggattccgaggcgggagcacttcgcaagaagtgcatcggactcgatcttggcctgagcgtctccggccctgagacgtgcctggagctctctggactgcttcctgaagttcctgagcatggtctcggccttccagacctcggtcttgttcttcagtccgaactggcggacggtctcgttctctgcctttatcctctcgccctgccaagggtgggaaggggtgtcataggtctttcttgaaaatttaggatctcccattcaaatcacctcaggatttcttctggactccgactgcgaggcccttccttccgttggacctggtcctctgtccccttaccttgtggttggtgtcgtgcctgatgccgcgatagctgcggatcatcttcatcctgttgatgtcatcctcctggaggatgttgaggtcgttcccgaaaaggtgcatgtccgctccggactcgtaatccatctggcggttgattgcccaggagggagcgtactcgacgtagctcaggacgagcttctcgaggtctgcgatctgctcgtcggaaagggatccgatcttcagggatccatcgattccggccctcttgacaatgatctgcgataccctctttccgacccctttgatgctctggagtccgatgacggtgtgtttaagtccgtcgatatcgctgtttgcaatacggacgatgtagttgaaattctcgtcctcggtctttgccgaagccttcttgccccccttcttcttgtcggcgggtgcggcctcaggctttgcgttagctgctttaggtgctgccattgttcattcctccgtaaatgttccctccgtttccggaaggaaggctcaagcgccaattccccgcagggatgcgctctcagttttcaccccgatatgcggagcgggtcctgagtttacgtaaagagtcggattctattataatataaaaagagtggcacaccggaaggagatcgaaggatgggggcccggacatcctgtcaggtacccgatacggagagtctcgtcccggtctccgaatatgcctggtcggaggtctgcacggagaccttccatatgcgacacttctcgccgacgtggaacgtgtattgataggtcccgtcggatgacacatatacgtcggtggaaacggtccccgtttcaccgtctggaacatcatcccttccgacatggtcgagaccgaccggcacaccatccctgccgaagactatgcctgttccgaaaggctccatgtctccggacacggacccgtccgagttcccgtatgaaaggaagaagtcgatacggtacacacgatacaagtcggactcctccttgaactccagcaccgcagtgccatacgcatccagcccctatacgccttccgaatcatatgtgccagacattgaatattcgtactctccgctataaccgtccctttccgataaggtgctgaggacgaagtaggatacgcctaccgagacgcacattacgactgcgaccaatatcgcaaatgccaccttggtgcctttcacgtaaattcggtacctcataattgattatttatcaggatcgatagctcacgctgatacagtcccggaaatcgggggatcaatgcaggatatggtcgggatcgatacccaaggccacgatacaatcgaagaacaggtcctggagggcctccggcccatccaggcacgcataacatgtcagcgacagctatcgatcccgattctgaacaacagcccggatgactccggatccatgaagaaaacagaccttccggtccaaaataaaatcaaattgtcaaagtgctgaatttacgtttcatatccgacatccgggaacaatctccctgttcgtatttgttccctcgcatcgacatcgacagactaaaacaggacaaagataacggatcgtaaacccgtccatatcaaaataaagtatggtgccgacgaccggattcgaaccggtgaaccgctagggaacagatcttgagtctgccgcctttggccagctcggctacgtcggcctatatgcccccatgcagggacagtttaaatgtgttttcaaggaccggtggttatctctccacgtttcccggcgatatagaaagtatgctcgaactgcgcgaccataccgccgttgatttccacgagctcgttgaacccgctgaggatacctttacgcatcaagagtttcacccacttctccgcatcggggaaatcgcaactcctggcacaaaaaggcgagtcggggaactcctccttcacataggtgacgaactcatccgccttgggattgccggacggcttgtcgcgggtcaggatgactatgttcccatgcttgccgttgtccacatatcctccgccgttggtggcaaagggctctatggccacggtcataccggcctccagcatggtattgtccccgttgtcatatggcgccaccgagaaccctgcatggaggttccacctgtcgatctggtgcccgcagaggttctccacgaccttgaagccgtccctcttgacgctgccctctatggcggcaccgatctcgttgatagggatacctgcaccgatgaactcggccacggtatctctggccctcttggcggactcgatgaggtccgtataattgcgggtaccgacttcgaccgtaccggctgtgtcgccgataaaaccgtccagcattcctccgcagtcgatctttacgacgtctccgatctcgaaacgggtctcgtcgttacaggagggagtataatgggcggcgacctcgttcctgcttatgttacaggggaacgaaagaccgcacccgtgctcgcggatatatccctctacctcctgtgccacatcgtacagcttcactccggcctcgcacatgctcataccgagctctctggcggccccggatatctctccgaccttgcgcaatttggcaagctcatcttctttcagcattgtaatacttccttgatcatatcttccgttatcggaccctgacggatgatctcgtactccttatcctttatccagatgatcgtggagggcttacctgaggggctgtggcccgcatcgatgtatgtggagacggaattacccagtgccgcagtggccatccctatgtctatggcatccggctggaagtggatgttggcggaggtggctacgatggggccggacctcctggctatctccaaggcaatagggtggtccggtatacggatgccgaccttctgcgagccggccgtcacgatatccgggacctcgggattcttctttatgatgatggtgaggggcccgggcaggaatgccttgatgagcttgtctgcggtttcattaaggatcgccacggactccatcatcttcctgtcggcgacagccacggatagggccatgtcgaagggtcttctcttggccagatagagattctttacagctacttcgttgtatatgtcagcccctatgccgtagacggtatctgtggggtagactatgagattacccgcagcaatatcctcggcggcagacatggctgcctggatgcagttgtcgttcaatcccttggaacagtcacacttgagaaccctcatcttaccatccttccatcatctttaccgcttccctgacagactcgttgccgtccggagaggcgggtccatgcccaggatacatcattccgatatttacgttacgcagtttggataacgattccgccaacttggacgtcgagcctcccgggagatctgtacgtccataccccctggcgaacaccgtatccccggagaacaaactatgggtgacctcatcatagaagcataggcctccggcggtatgtccgggggtggagatggcacgaagcctgtggtcccctatgtcgaacacctccccttcggagagggccttacatccgaccggatccacttcgacccccaactggcgagagaacagtacatcccggtcgttggaactgtatggtccgagatcgagagtgcccatatatgcaggacatccgaactcccttacgatggatgatagtcccccggaatgatccgcatggcaatgcgtcagcagaacacatgaaagacgcagaccgtccaatgcattccatatcccctcgatcacattatcagaatcaagaccagtaccgcaatccactaaaaccgaaattctgcgcgtgtaagtaactcaacccttgggagttgcgagacatctcagatcgcatacctcgatgcccaagacgggttcattgggtacttccactccgaacattccgaagatgttcctgcagttcttggatatctccgaaagagcggacgaagaaccgtaactcagacagttgatcgtgttcaggtaccccagagtctgaccgacggacatctcccgtttgccggattcccttatctcagcgcacagttcgcatttgaggatcagtgaaacgaactttatcagcgaacgtccgatcatcgtgtatttgtcgggagtacggtgcctcctgtcgtccgatttgctgaaatcgaacgcctgttcggtaagtctccttgcgtcatatgccgtcataaccgtcgaccagtccagatccgatgaggataacatgacgaacactcccgcgcggttctcagcgaagcttacggaattctgcttctccttgacgatcaccttcttcccgtcggcctgtacatcgaagtgtttgatcgccttcccagcgatcttcttgaacctggccacaggatccttgcattctatctctgcggccttcctcttcagatcgttgagcatcatcttgtggttctggacctcgtcggagtacttcttggaatcgaaacatacgtatgcgttgatcataccatcatccccgtgtccggcatcgccggacaccgtgaaggagtatgcctgcgatccgtccgcggatagcctgtcggcttccgtcagaccgatctgcgtcttccacaccttatatgcatgtccgtcgtgaatcatatccagagattcgttggtcttcacgaacctggacatcagcgttttgatcgctttggaggatgtgttcgcaggggcggtgaatcttatccccttgtccaggaggtgtttcacattggcacccgaaacgaatcccctgtcgaatacgaacaaagcatccttcttcccgtatctttctatgtcggacaccatcctgtccacggtagctatatcggagatcgtaccgggataatggcggaacatgagggggatgcctctcatgtctgtggcgaaaccggtcttcgtctgcttgatatcctctccgtccttgttgttcaccacatattcggccatctggtccagttccgaataagtgccgttggtggtcgtatcccaggccaccagcccattggatcccttaaccctgagttcgaagaaacggtcgatgttcatcgccttctccccgagattcctggtgaagtccgaaagcgttcccgaatccatcgatgctctgagatcatagaattcgcggatgtacgtcctctccaaagtggaatctatgttcctgaatgcgcccggttccataagataggccatcgcagccgcgagaatggtcttccccgaattgccgaatgccctcatgaggtcctcgccgagggacatcctcagctgcacttcgtgcagcaggtatgtcgccccgtactcctttgacgacacacctttgagaatcgcgatctccttctctttcgcgatttttctgcggttctctgcagatttttcgggaatcttgggaagcagctccttggtgtcgggatccaccctgcccaagtaggtggaaacggtctttttcttaccgttttccatagtagaggttacctcataagcatagaatctgtcccctcttttgacgatcgtgcgtttgattccgtctccatccctcggtctgaccatgttattacctaacataaactgtatgtaagtaatggtatataacacctcttaccgtaccctagccagcatatgaaaaattgatcagaaaacaggattgcgattacttagcacgcgcagaatttgggactaaaataccggatctgccggtgatcagatagatgttggaatcgaaaggaatggatgagtcgattctgcatacagtcatatggaaatacccaataaaacgaactatatgaaatgaactaaacaacaaaatgattaaaatgaaaaggaagagagatacacatacgtaacctgtttgactgctagatcacatccagcggcaaagatgttagttagccaggactgaatacctcggcgaacctcagtacttacatccggcttctatcaaacccgtcatatacggatatcttatagtgcctctttttcaaggtggcttcgagcttagatgccttcagctcttattcactatcgcgtggctactctgcctgccttgtcagacaacagataaactagaggcgacgaatccctgttcctctcgtactaaaggatccttctcgtcaggcacgaacaattccatcaaaaagcaacaaaactgtctcgcgacgttttaaacccagctcacgatcccttttaatgggcgaacaaccccacccttggcagatgctgcaccaccaggatagggagagccgacagcgaagtagcaagccacggggtcgatatgaactcttgcccgtgacaactcaattatccccagggtaatttttctgatatcaatcgcccccacttgggaggctgattggttcgctaagccatagtttcctatctccgaaccctattgtctggttccgagtcaagctagcttttacctttacattcttcgtaagatttctgaccttactgagctaacctttgggcgcccttgttatctttttgagggcgtggcgccccacccgaactgcccgcctatagctgtcccctcgaaagggtgagtcgtaagaaatggtaaggacggtgtttcatcgttgactcggagagaagctagcgctccttcctgggtaacgtctcccgtctaccctacacataccatctcctacaacaacaacaggttgcagtgaaactccatggggtcttcgctttcagatggaatgatctggattgtgcaccagattgattgttttcactagcgtcaaggtagggacagtggaaacctcgttgagccttcatgcaagtcgccaattaagcgacaaggtattacgctaccttaagagggtcatagttacccccgccgtttatcggtccttcgaccggttgaaaccggatttcagatgccgacactgggcaggcttcggccccaatacacatcctttcgaactagctgggacctatgtttttactaaacagtcggatttctcttgtcactgcgaccagtagctctcactactggcaccctttatcccgaagttacagggctaatttgccgaattcccttaccttgattatgctaacacgccttaggctactcacctagggacacctgtgtcggttcttggtacgattccaacacttgtaactatggtgttttcactgggaccagggattaccaaaagcgggattactcccgccccatcgcgctttcggaggcttctcaccattacggttcttcacctcgttagacgtttagacaagctgacaggcttgctttagctaccccgatcctgcaccataggcaaagagtgttgaagttcaggaatattaacctgattccctttcgataacctcgattaagagttaccttaggatcgactaacccttggctgacgaacattgccaaggaacccttgcccctgcggcgacatggattctcaccatgctatgctgctactcactccatgatcctcgttggtacacggtccataggacctcacggccctacttctgcccatgcaccacgccccgctatcaaattacattgctgtattcttaagtatcggtactcagtttagccccgtccattttctgggcccataatctcgaccggtgagctgttacgctatctttaaagggtggctgcttctgagctcacctcccggttgttttagactactgacgccatttcatattacacttgactgagatttggggaccttaacttaagtctgggttgtttcccttatggctaccaagcttaccccgggtagccttgcatccgatgtctacggtgaacgcaagttcggagtttgacaagacaccgagaggtttccctccctaagcatccaatcggtgctctacctcacattctgcctcgatcgaagtctagctgcgactagtttcgcggggaaccagctatatccggcctagattggcctttcacccctatacccaagtcatccaaacgatttgcacatcagaactggttagctcctccacctccccttcggaaggcttcaagctgctcaggcatagatcgaccggcttcgggtctccgcaccattgactaaaggcgagcacaccttgcccctcgtaaaaactgcgggcaatcggtttcccttcggctacctgattgaacagttaacctcgccaatgaccagaactccatggatcggttttctaaccgaacggtacaacactggtccaccattgctggcttcttccctttcatgccgtactaatctataaccgtatggtttcaggtcttttcatctcccgttaagggtacttttcagatttcgctcacgctactactgcactatcggactagagtaatatttagaattggaggcaaatgtcccccgtcttcacgcgagatatccaactcacgctactccggacatccatcaatctccgtacaggccttcttctaaggggctatcaccctctatggcatgtctttccagacaatttcgaatatccctgcccaaggagtaaatgggtccaacaccacatctcccaatactttcatattgggattcagtttgttctataccgcgttcgatcgcctttactagcggtatctcggttgatttcttttcctgcgggtactaagatgcttcaatcccccgcgttccctgtcattactgacaattccgaagaataggaagtcccattaggtgatcgtcggatcataggcttcttgcaccttcccgacgcttatcgcagcttgacacgaccttcatcagttctctagccgaaccatcccccatacggcgtagcatcgccgctggcgtatgatctagcacacgtccaggttacgtatgatcggttgtcatcaggctttattccgctctctcttcctgtacggagccctcgaccacttccccgcgtgagtgcttctcaccgggtgcatgatagtgagtcgggttcgcgcccaactcagcaaaagtcccagatgcttaggttatatttaaaccttcgcattcaggggattttcgcggtttttggttgcgaaccttccctcgataattcgcaagtatttcttgcggaccacacgatgccacacatcgcgcattcccctctacacacaagtagtataaataattattggtggtgtgtaaaggtcacggcgtaaaaaccgtgaaaataagaccgggaatgagcttttttaggcaaatcaagtcaggataatacacggaaatgcgatcttcggcgtgaacccggcggccgagaaccctcgagaccaccgcgacctccgtcatcccgtcgatcttccaaccgccattctccgaggatgggtcggtggaaaccaatatcgggagcctcagaaggagtttctcctgatcggtacatatcgagtcgaggtaatctatgccgcatctgtcgaacgatgctttgtccccgctgcgcgtatcaaacgtatcgccgccgttctcgatgtaatccatcagagtgcggcgtctcaccggcaggttgctgttcatacccgcaatcatcgcctcgatgttgcggggatcgtcctcgatcccgattgtcattacgtccctttatcttatttattatattaaaggtagaacattgttcgatgcatttggaaacaaatacgggctcacaacagctccaatgcagccgttgcggatgccatcatggctaaacggcgactgttaccgccaccgattatgaggacgtccccatctattggacaggcggaaatacgcaaagcggcggcaaaaccaggatccttatcatccacattccagtcgggaagcattatgatccccccacttgtcacgacccatgtcgtacaaccatcacccccggcccttatgcctgcatccctctgatctatcccattgaatactttctcggaagccccactcaccagaatcccttgggagtgttctccgatgacatatctgcctgcatccatctcgaatgtacgcatccccaaagactccaggaacatcttcccttcggaagtgatccctatgcctgcttgccttacggagaccagccccatgtcctccaaaatagataccaatctgcggacgctcccttctccgattccgagatggtctccgacagagaccctgctgaacctgccgcctctacaaagaagatcgagggcatagaaaacatcggcatccgagaatctgcatgcgggaccatttttctgcttatccaataagaggaccatagcgatttcaatccaaatacagcgataaaaaagccacatagggttggaccattggcctgacggatgttttttacaaacccatccaacaaatatggagggcagcactccacatctgggtgctgtaggattgattgattaagcttctggtatatctgttccttggacaccatgaaccaggaggacttctggccgtcgaagatgttgttgcctccggccttcgatatgagatccgacatgaacgtgttggaaccgctggtccatggacttcatatggaatccgaagccgcagaacttacatgtacgtgtcttcctctccggcacatcccatcttgaagaatgacatctgggacatctcttcggcatctgttcggaacgggggatccaagcatatccgcagcgataacagaaccttggctgcatatcggacgcacacgtttccttgggcggtccggacgagacgttcacggatgctcatagatgttcggccgatgtaaaactatcgcaaattaagaatggaatatacatccaatttaggacctattcttcctagaacgatatggaaatggtgtgcgatacaatcccgctcccgtacctcgcaatccgctttataaatgcagacgatatggagaggatgtatcatatgaacgccgatctcgaaaaggccctccagacccatccctgctataacgaagaagcccaccggaagtacgcccgcatgcatgtcccagtggcccccaaatgcaacatccaatgcaattactgcaaccgcaaattcgactgcagcaacgaatcccgccccggcgtcaccagcgaagtcctcagccccgaacaggccgtcgccaagatcggatacgtaaaggaaaaggtccccaacctgaaggtcctgggcatagccggtccgggagacccgctggccaatgaggagaccttcgagaccctggcacttgtgaaggaaaaataccctgacctcacactgtgcgtatcgaccaacggtctcgccctcccggagaacgcggacaggctctacggtctcggagtgaggttcgtgaccgtgaccataaatgcggccgatgccgcgatcggggcggagatatacggctccgtactgtggaaaggaaagagatacaccggagaggaaggtgcatccatcctcctggagaatcagctggaagggatccgcagatgtgcggatctgggtatgctcgtgaaggccaacatagtcatggtcccggacatcaacgccgaccacatacccgacctcgtgaagaaggtcaggtccctgggcgcatacatagtcaacatcctcccgctcataccggtggaggggacgagattccaggacatgagaggtcctacccccgaggagaggaaaagactcatggacgcctgctccgtggacgcccgcatgatgcgccactgcagacagtgcagggcggatgccatcggtctcctcggagaggaccgctccggggagttcgcaggatgcggtctcgggaagggggacggctgcggcccttccgaggatgttcccaacatggtatccttcgacatggggaggaaatacatcatcgccgtggccagcgacggagggaagaccgtggatgccggcttcgggaacgccggaaggttcctcgtgtattccgtcgatggggaccgcgtggaactgctgagacaggtgaggccgggggacctggggtcggagatgaaaggcgcgtcccacaaggaccacatcgaggccgccgtcaccctcctggacgactgcgacatcatcgccgtgagggagataggggacatgcccagacgcgtcatagaaggccgcgggaagaaggtgttcgtgacctccgcccccgtgagggacgcagtgacctccgcccggtgaccgtccgtctgggtctcgcgtccgagacggtctgtttttaaaatacatatatgagaaccttatagcgaagcccatcggaagtgcgcatatggaagcacaggaactcagagaagcctatatcgatttcttcaaggcgaggggacatgcacagatacgttccgcatccctcgttcccgagaacgaccccacagtccttttcaccactgcgggtatgcacccgctcgtaccctacctgctcggagagaaacaccccgccggcacgagactcacggatttccagaaatgcgtgaggaccggcgacatagacgaggtcggcgacgcgagccacctcacgttcttcgagatgctgggcaactggtctctgggcgattacttcaagaaggattccatcacctggagctaccagctcctgcaggaggtccttcacatcccgccggaactcctggccgtcaccgcgttcgccggcgacgacgacgccccgaaggacaccgagacggcggagatctgggaggcacagggtatcgcgaaggaccacatattcttcctccccaaggaggacaattggtggggccctgccggacagaccggcccctgcggaccggataccgagatcttcttcatagacaagacgaagaagccttgcggaccggaatgcagacccggatgccactgcggatactacaccgagatctggaacaacgtcttcatgcagtacttcaaggacaaggacgggaagttcacccccctgaaacagaagaacgtcgacacagggatgggactcgagagggccctccgcgtcgtcaaccatgtggagaccgtctacgacacccccctgttccagccgatcatctcgaagatcgaggaactctccgggaagaagtatgcggacaacatgaaggcgttccgcgtcatctccgaccacatgagggcgtccacgttcctcatagcagacggcgtcgttccggccaggatgggcggcggatacatcctcaggcgtctgatcagaagagccagcagatacatgtcccagctcgatgtggaaggggtccgcctggcggaggtctccgaagtcgtcataagggactacagcaaggcatatcccgagctggaggccaacagggagaccatcctcagcaccatcaccgcggaggaggagaaattccacagcaccctgaagaagggtctaaggagattcgacgaggtcgtggccaacaacggggactgcaaggtcctcaacggagaggaggtgttccacctctacgacaccttcggattccccgtggagctcaccagggaattggcggccgaacgcggctacaccgtcgacgaggaagacttccagaagaggttcaagcagcatcaggagacctccaggatggacaccaaccaggtgttcaaaggaggattggtggaccacagcgtggagaccaccaaactgcataccgccacccatctgctcaatgcggccctcaggaacctgatcgaccccgacataaggcagaaaggaagcaacatcaccgcggagagactcagattcgacttcaacttcgacaggaagctggagcccgaagagatcgccaagatcgagaaatatgtaaacgacgccatcaaggcggacatccccgtggtctgcgaggagatgaccctcgaagaggcacgtgccaggaatgcgatcggggtgttcgacaacaaatacggcgagaaggtcaaggtctacaccatcggcgacgtctcctgcgagatctgcggaggcccccacgttcaacacaccggtgagctccagggattcaagatccagaaggagcagagcagtgcggctggcgtaagacgtatcaaggccgtcgtcggaaaattcgactgatagtcgattttagcgggggtctcccccgcatcttttttacacatacgcttgccggaacatgtcggcaacgtgctttaagtccatgcacctcgatatacatcattacggtgagcgaatggaggacacggacgggataagggaagaactgggacttgtgcagatatatacgggaaacgggaagggtaagaccaccgcagcattcggcctggccatgagggccgccggaagaggactgggggtcctgatagtacagttcctgaagccatccgacggatacggggaacaagtggcatgcaaccgcatggggaacataacgttggtacctatgggactggaccacttcgtctccaagaagccgtccgatgccgacatagaggcggcacacaaggccctgagaagatcggaagaactcatatgttccggcagatacgacgtggccgtactggacgagagcataaacgcggtccgtctgggtctcatcacatcacaggaactgatagagtctttggaaagacgcccggatcacgtagagatcgtactgaccggaagagggatgacccccgatctggaggaatatgcggatcttgtcacggagatgagacttgtgaagcacccgttcgacaaggggatcggtgccaggaagggcatagaatactgatccgacctctaaaacggcccgaaaaatacacctacatggtctggtagcacttattttataatgtaaaataataaacgcataacatttaataatatcgtgttatcttagacatggcccgaaaagggcccggtagataacatgtggcttataatcgcagcgatagcggcgctgaccaccacctatatgtggctgcacagacccccggggacggaccgtctggcacagctttcgatggtgttctggggcctgaccctgatggccttcgtagaccatgtgatcggatggttcctcgatggcgcagaaggagacttcttcgatatcggagtgaacgagttcattctgagcatctgcgtgatcgtccccatactggtgatctgggaaggagccctcatagcagacagattcaggcttcgtcaggcgatggccgctaagacggacgatagattgagagagaagaaggagataatttgaatggcatgtttccttgtcgcggcggtggtcggcatattcacgaccgtcttcgctaagaagattcctgagaaataccacatcgagtggctgaacgtgatgatatggggaggggtgctggcacttcttgtggaacacgtatggcacggagagatagtaccgtggttcccgttccttacggccatggaaagcccggatgacaccgccgccatgctgaccgagatggcacagataggaataccgatgcttctggctatcgtaggtgcatgggcacttatggtatacatctacaacagatgtgtggaggcgtcgtcctccgtatcccccgacaccgtctgatgaggacgtctcctgccggcgggagctgtacaccggcatagggcccttgggccttcattcctcgacgacctgaacaacaacgccgcatactcgacagaacgattgcaatatgtactatgcgccgaggggcagaaagaagacgagccagcaaaaggagtggacagtgtgggatttgaacccacgacctcctgcttgcaaagcaggcgatcttccagctgatctaactgcccatcgaggtactgcagatgtatctcgcaataggacgattgacatgcggaataaatatctttctatcgatgtcttgtccacagaggtacgatgcggccagggagcgacttttatagtttgtaatcgtgcgtgcgcacatacagaagcttcatggcttcggggtgatagattgtacaccttgggaaaaaaattgagattctccctgttcggaaagagtcacggaccttgtgtagggtgcgtcctggagggagtaccccagggaactcctatcgacatggagtcgctggcacatgacatggccctacgcaaaccatccaagggaatagggacggaccgcgtcgaagcggacaaggtagacgtcatctgcgggatcgaggacggcaaggccgacggaaacgccataatcctggagatcgccaacgggaacgtagatgattccaaatatctgcctttcgaagagacgccccgtcccggacatgcagacctcccggcactgctggcacttcctaaattcgatatcaggggaggaggacagttctccggccgtctgaccgctgccatcgtagcggcaggcgggatagccagacagatgcttgcggccaaaggcatagtcatagggtcgttctgccgctccataggaaacgtggaggactgtgatgaaagggggatcgaggacgccaagaggtcggaaggattccccacaagggcctgcacccccgaactcgatgcgatgatgtccgactgcataatggcggcaagaaaggacatggacagcgtaggaggggtagtggagtgcatagtcaccggactgcccattggcttcggaggcatctggttcgatagcctggatgcggagctggcacatgccgtattcggcattcctgcatgcaagggggtggagttcggaaaagggttcgacatcacccgtatgcgcggatccgaatccaacgatgcgtatcgtatgaaagacggaaggatcgtcacgaagaccaataacatgggaggggtcgtcggaggcatgtccgacggggcggacctcgtgttccgtgcggcgttcaagcccaccccgtccataggggccaaacaggaaacggtggacttgaagacatgcgaggatgccgaactagagatcaaaggacgtcacgacccctgtatcgccccgagagcggcctccgtggtggaagcagtcaccgcattggtcctggcggaccagatggagaggggactatgaacgacggatatctggaggagaaaaggaaggccatagccgagaccgacaaggagatcataatcctcctgaagaaaaggcttgatctggcgacggagatcggtcaatacaaggcccagaacggactcgaggtgagaaacctcgacgttgagcagagagtggtggacagatacagatacctggcggccgaatacgggatgaatccggaccgcatggagcacatctgccgcaccatcatgcaggagtctgtagaaagcgaggctgccatacagggggttcccgcccccgatgtccatgacaaggatccgcataaggaagagatccggatatccgagaccgacatcgaaaccggacggaggaagatgctcggcatcggagtcgcctctgtagccgccatactcgttctcaccgccatagcgggattcgtcttcaactcggacaacggactcagcatactgtacctgatggccgtgccgatggccctcatagccttgtgcttctatctgggttacaaggacatggcctccggaaagaacgccgaggacctcagatggatcaagaagcggacgttcatattcggcggactcatgatcgccataacggttctgatcctggcattgttcataatacgcggataaaccatccacccgcatcggacatggatccgatgcgggatttttaataaataaatgggcccgaggacccacagatgtttttcacttactcgagataggcgccgttcacaccgttggtgacgagtttcctatatttcttctggacacccgtcacggggcggtcgacaatctccacttcggccagacgggcctttatctcctcatcggaaagccttgcgttgagctttctgttggggatgtcgatgtctatcatgtccccgtcacgcagagcggctatgggccccttctcataagcctccggagacacgtgtccgatagcccctccacgggtggctccggagaacctgccgtcggtaatgagtgcgacggtctctccgagacccattccctggatgatgctggtcggagcaagcatctcaggcataccgggtgcccccttggggccctcgtacctgatgacgacgacatctcctgccactatgctgccggacttgatggcctcggtcgcatccttctcggaatcgaaacatctggctctcccggagaagaccatcatcttcggacttactgcggcctgcttgatgacggatcccatgggtgcgatgttacccttcaggatggcgatacctccctgctgatgataggggttgtcaagaggtctgaggacgttctcgtcggcgatcgtcgcagactcggctatctccatgacggacttgccgttgacagtgggtgcatcctcgatgtggtcgatgagtctcttgaggatggcaggaactcctccggcattgtcgagatcccttatgtggaactgtccggcaggcctgaggctggttatatgcggaacctccctggagatcttgtcgaactcggagaggtcgacgggacaaccgaactccttggatatggcagggatatggagcgccgtgttggtggaccctccgatggccatatcgacgcatatggcattatggaacgagtgggagttgacgatgtcgcggggcttgatccccttcttcacaagttccacgatcctctttcctgactccttggcgatagcgagcttcttctcatccacggccaaggatgtcccgcaaccggtcagagacataccgagagtctcggtgaggcatgccatcgtgttggcggtgaagagtccggaacagctccctgcaccgggacaggctgcacattctacggtcttcaagaaactttcatcggcagcgcctacctgcacttgtccgatcgcttcgaagacggactggaagtcgatatcctctccgttgagcttgcccgcctccatggcacctccggtgaccatcagtgcagggatgttcatcctccctgcggccatgagcatccctggagtgaccttatcacagttggatacgccgacccaaccatccatggcatgtccttccaccatgacctcacagcagtccgatatgacctccctggagatgagggaatacctcatccccttgtgacccatggcgataccgtcgcatacggcaggagttccgaaaacgaaagggactccccctgcctcgcggataccctctttgacggcatccacgatcttgttcaaatgtatgtgtccgggaactacctcgttccaggaatcggcgatcccgatgaacggcttgtcgaagtcttcgtccttgagaccgtctgccctgagcagactccttgccggtgccgcatcgacaccgtgctttatgacgtcgcttctcatgtttgacattgaagacccctatcgtatcgacgattaataattgacggtctgcaggaagcattggtatgaaaaaattgagcgtacagcgctatcgcagcgcagtgcggataatcctggacggggaagaccccggcagaaacaaaaggttggaaccttgaataggtttgttgagatcaggcgccgcggaggacgatctcgatgtttacaccatcgaggacctggatcctcataagctgcctaagagcacgctcatccgcatcgaggtcgataagcctcttgtggatgcgcatctcccacctgtcgtaggtctcgctgccttctccgtcggggctcttcctgcaggctaccttgagtttcttggtaggcagaggaacgggtccgcggattgcaacaccagtcctctgggaaatccctttgatctggttgcagacgctgtcgaccatagcagggtccgtgccgctgagagagattctagcacgctgtgacattgaaattacctcttaaattgttaaagggagaggggttgccccctcaccctttattgggaattcaagccttctcgacttcggtgcagacaccggcggcgacggtctgtcccatgtcacggatggcgaaccttccgagtggcgggaagtccttggcgggctcgatgacgaggggcttggtgggcttcactttgacgatggcgttgtcaccgttcttgatgaagctgaggtcggtcaggggctttccagcgcggttggcggagcagatctcggtgatctggcaggcgacctgagcggtgtggacgtggaacacaggggtgtatccgacggtgatgaccgaggggtggttcagcacgatgatctgtgcggtgaaggattttgcaacggtcggagggttgtcgacgggtccggcgacgtctcccctcttgatgtcgttcttggcgactccaccgacgttgaatccgacgttgtctccgggaacggcctcgggcagctgctcgtggtgctcctcgatggacttgacgactccggtcgcgtgggagggctcgaagatgaccttcatgttgggcttcatgactccggtctcgacacgtccgacggggacggttccgataccggtgatggtgtagacatcctggacgggaaccctgaggggcttctcggtgtgcttctcgggaacggacaggttgtcgagtgcctggaagagggtaggtccgctgtaccagggggtgttctcggactttaccttcacgttgtcgccgcagtatgcggatacggggatgaaggggatgttctcgaccttgtttccgaccatcttcaggagctttgcgactccctctttggcctcgttgtacttggcctggtcgtacttgactgcgtccatcttgttgatggcgacgatgatctgcttgacaccgagggtggttgcaaggaagacgtgctccttggtctgagcctggggaccctcgatagcggagcaggtgatgatggctgcgtctgcctgggaggttccggtgatcatgttcttgacgaagtcacggtgtccgggtgcgtcgatgacggtgaagtagtacttgtcggtgtagaacttcttgtgtgctacatcgatggtgactcctctctccctctcctccttaaggccgtccatgacccatgcgaagtagaaggatccctttcctttctcctctgcctctttcttgtatttctcgatgatgtgagggtcgattgcaccggcctcgagcaggatccttccggtgagggtggattttccgtggtcgacatgcccgatgatgacgaggttcatgtgctgtttctctgccatgttcttgtctcctttatttactcgttagagttagtttttgtgcgataagggtgtttatatttaaaggttttagacgaacccatccggcttatagtccggagtagtagttcgcatcgtaaggctgggggttcaggccctttctggtcctgatctctccgacgaccttctcctgcagatcggggaacatctcctcgaatcccgcattctcggtcgaccagagagcccttccctgagtggcaccgcggatgtcggaggtgaatccgaacatgtcggcgacggggcacttggcgctgacggtggagtcggctccgtcctgtcccatctcgaggatggttccgcggcgctgggtgatcagactgatgacgtttccggtgaagtcaggaggcacgctgatgaagacgtgctgcataggctcgagcagaaccctgccggcctggcacatggcaccgtagataccgtccctgacggcagggatgatctgtgcgggccctctgtggatggtatcctcatggagctttgcatccatgaggacgaccttcagaccggagaccttctctgcggcgaggggtcccttggtcatggcctcgtcaaatgcatcggcgatgagctccatggtctcatgcaggtactggattcccttggtgtagtcgatgaggacgttgtcgttcttgaacttgacaactccctttgcctccatggcatcggtcattccgaggtcctgaagctgcttggcaagggccttcgggtccttgatcttcgcatcggggtcgatctctcccttgtggatggcgtcgatgattccctgctcgagcctggaaacgacgaaggtgaacttgttgtgcttgttgggagaccttccctcgaagccggcgttcttgcccttcacgcactccctgtacacgacgatgggcggggagaccacgatggggattccctgctcgttctcgatacggtagacggtgatctccaggtggagctctcccattcctgcgatgaggtgctctccggtctcgttgttgatctcgatggcaagggacgggtccgcttttccgacggtcctgaggacctcgaccagcttgggcaggtccttggtgtccttggcctcgatggcctcggtgacgacgggctcggagtagtgggccatcttctcgaagggctccatgtcgatcatgctggagacggtggatccggcgatggcgtccttcagtccggtgactgcgacgatgtttccggccttggcgtcatcgatggcgatcctgtcggccccgaccatgagtgcgacggtctggaccctctggggagcgggctgtccggcgacatacagggtctgacccttctggatggttccggagaacagccttccgacggcgacctctccggcgtgcttgtccatgatgattttggtgaccatcaggacgacgtctccggatgcgtcgcagttcatgagctcctttccgaccttggactcgaggtctcccttccagatgatggggatacggaccttctgtgcgagggtcggaggctggatgtgcctgatggccatctcgagggccacctcgtgcaggggcgacttgtgtgcgagctccttctgtcctccttccttgctgcagtagtcgaagatgtcggagaaggagatcccggacttcttcatgaacggggcggagatggcccagttgttgtaggcggatccgaaagcgacggttccgtcctggatgctgacctgccactccttgttgagaggtgcgggcaggttggccttgatcttctcgttgaaggtggcgatgagcttggagaagcgctcgatcatcatctccttggtgacctgctgctcgacgatcatcctgtccaccttgttgatgaacagcatgggcttgacacgctctttgagcgcctgcctgatgacggtctcggtctgaggcatgataccctcgacggcgcagcagaggatgaacactccgtccagagccctcatggccctggtgacgtccccaccgaagtcgacgtgaccgggggtgtcgataaggttgatgaggtaggactttccctcgaagtggtggaccatggacgcggatgccgcgttgatggtgattccccttgcggcctcctgctcatcgaagtccagaacacactgctttccagcgaggtcctccgacatcattcctgctcctgcgatcaggttatcggagaaagtggtctttccgtgatcgatatgcgcggcggtcccgatgttccttacgaactcgggagtcttcataatggtcgtcgcgtatttgacattctcttctttacgtcccatactcactcaccttatcgttaacctaatcacctggcggactgggcgaccctctcggtctcctctttcttcgctacggcgaaggaggtcatgtctcctttggctgcgagcatgatctcgtcggccaggcagtcctgaatagttttcttgttctttgcagatgcagcgacgactccgctgctgacattcctgagggcgatgtcgagcctcctctggggggagatgtcgacggccttggggacggagattcctccgaactgcagcctggtgacctcctcacggggtgctgcgttctcgagggcctccacgaggacctgtacagggttcttcttggtcttcgcggcgatgatgtcgaatgcatcggaaacggccttgtatgccttcagtttctttccggtgtatttctcggtcctcatgatgttgttgatcagcctctccacgatgctgaggttggactttccgaaccatttgttggcgtgcttcccgccggagtgggggacgctggtggagttgaggtcgatgtactttgcaagaccggcgtcgttgatgacgatctcggtcgtgtcgtatttgccgaagacgggtgccttgggggcgaccatcttggttttctcctcggcaggtgcggcgactgcgacctgctcctgagtctgaacttcttcgtctgccatgtttcacaccttcatctggtgggcttctggaccctgccccttaccatctcgtcgagggagacgttgttgaccttgatgaccttgtaacggactccggggatatctccgtaagaccttcccatccttccgccgataccctctacgaggacctcgtcgtgctcgtcgatgaagttgatggctccgtctccgacggcgaatgcggtgatctgacgtccgttcttgataagctggaccttgacgcacttacggatagcggagttgggctgctttgcctcgattccgactttctccagaacgatgccgcgtccctgtgcggatccctcgagaggatcggacttctccctcagcttcagtaccctcttcttgtatcccctgtctagccagcggaacttctgcctgtctgcctgcatttttcttgcagtgaatagaccgtttcccattgttttcacctattttgggtttgttttttcgctcgcgatgcgattatgccccgcgcaatatcattaaatattgctaagcgtggctatgctgagggtcgctattcacagattatatttaatggtttaccagagaaaatacaaaaaccaagcacccgcggtatactccgcaggtcattcgatatatccagaacatgaatataatgatgtcgcattgaatgccgtccttgatacttaatcgtgattttttagataaaaccgtacaaaaacaacgactaaatgacatcacatggacgtttgaacatcatatccgccatttctatcacaaatgtttattaacgatttatgcttagagaggttcccgttgatttgacatgaaattgattttcgtcagcggaggagtaatatccggattgggaaaggggatcaccgcatcttccatagggcgtcttctcaagtcgagaggcatcaacgtgacatccatcaagatcgacccctacctcaacatcgacgcagggaccatgaacccgttcgaacacggggaggtgtatgtcctggacgacggcggggaagtggatctcgacctcgggaactacgagaggttcatggacctccatcttggaatggacaacaacatcaccacggggaaggtctacaggaccgtcatcgagaacgagaggaggggggagtatctcgggaagaccgtccagataatcccccacatcacgaatgagataaagaggaggataacggcggtcgccagacagtccggggcggacgtggccattgtggaactgggagggaccgtgggggacatcgaatccatgcccttcctggaggctgcgagacagctcgggagggacctcggaagagaggagaacgtcatgttcatccatacgaccctcatccccatcatgggatccgtaggggaggagaagagcaaacccacccagcattccgtaagggacctcatgtccgtcgggataaaacccgacatcatcgtcggcaggtgctccagggaactcagcgaatccgccaaggccaagatagccatgttctgcgacgtggacgagaatgccgtgatctcgtgtcccgatgcacgctccatctacgaggtgcccctcatactggagagacagggggtcgccgacctcatcatcgacaggatgaagctcgcccccatgacgaccggcaggcacatggagaaatgggagaggttcctggacaacatagtgaacccgtcctccgaggtcaccattgccctcgtaggcaaatataccgccctggcggactcttacctgagccagctggaggccctcacccacgccggtgccgagaggtgctgccatgtggggataaagttcgtggacagcgatacgctgttgcacggcgaccccggggacatcctcggggatgtggacggaatactcgtccccggagggttcggcgtcagaggcgtcgagggtaagatcgcggccgccagatacgcaagggagaacggggtgccgttcctcggggtgtgcctcggattccagatagccaccatagagatcgccagggacgtcctcggcctcgagggcgccgactccaccgagttcgaacccggcaccaagcacccggtcatcttcatcatgcccgaacaggccggagtcacccagatgggcggcaccatgagactcggcgcccagaccgtcctggtggagaagggttcgaaggcggaagccctctatggggcggacaggatatccgagaggcacaggcacagatacgaggtgaacccgggatacatcgaccggttcgaggaagcgggatggaagttcaccggacgctccgaggacgggaccaagatggagatcggggaattggagggacacccatacttcgtggcctcccagttccaccccgaattcaaatcccgccccatgaaaccgtccccgctccatcagggactggtagacgcggccatggcatacaggaaagaccgcggccagtaatggaaatcgcgcgcccgtatttatcgcgcgggcgcgcatacatttatattgggtaccatgatagcgaaccttattaagaggcgacccaaatggaagagaacgattatcttgcaatgctcgacagagcgaaatcccagcttcccgaccagatcgagcaacacgagaggttcgaacttcccgagctcgacatcatccaggaagggaagatcaccattttcaagaacttcatcgacgtgaccgacaagctcagaagggatccgcagcacctcctccagtatctgctgaaggaactcggtacccccggtaacctcgagggccgcagggtcgtgttcaaggccaagatcagtacgtcccacatcgacgagaagatcaaggactacaccgagacctatgtcatctgctccgagtgcggcaggcccgacacccatatagagaaagaggacaggacgttcatcctcgtctgcgaggcatgcggtgcccgcagacccataatggtcaggaaggccgccaaagccgaggatgccaacaccctccgccccggagacgtcatcgaagtgaccatcaacgacgtcggaaagaaaggtgacggagtagggaagtacatggactatctgatcatcgtcccggggaccaccagaggcaccaggaccaacgtcaagatcaccaacatctcggcgaagaccgccttcgggcaggtcaccaccgaggccgtgaaccactgaagtcccatgagatacttcgtagaatcgtacggctgtacgatgaactacggagagggagaggaactggccgagcgtatggatgcgctcggccacatccgtgtcctctccgccgacgaggcggacatagttatcctcaacacctgcaccgtggtagacactacggaaaagcggatgatcaagaggatgaacgagctcaaggcggccggaaaacaggtcatcgtcaccgggtgcatggccaaggtgcaggcgggaagggtgatggtacgcctccccggatcgctgatcatacctccggaggattatgatggtttctcggatgccgtatccaagatgtatgggtgcggaacacccatcgtacagaagcgttctccggtgacggccatcatccccatcgcacagggctgcagagggaactgcacatactgcataaccagattcgccagggggacccttaggagttattctcccgaggggatcaaggaacgtttcgacagattcatcgactccggagtcaaggaggtcctgatcacagcacaggacaccggatgctacggccgtgacataggaacggatctgggagacctcatacgcaaactcctggagaaggacggggagtaccgcataaggataggcatgatgaaccccaacagcctgaggccagtgttgaacagcgtcctggacgttttcgaagatgagaggatgtaccgcttcctccacatccctgtacagagcggcagcgaccatgttttggatatgatgagcaggcactacacctcggaggacttcttctccttgatcgacgccatacgcgaaagataccccgacatgagcattgccacggatctgatatccggattcccgggtgaaagcaatgaggatcatgaggaaagtgtcgccctcatcaggagactcagggcggacaccgtcaacataacccgcttctcgcccagaccgggcacggaggcgttcggaatgccccagataaacggaaggatctcgaaggagcggtccacggaactcacggaggtgaagaatgccaccgagaacgatgtgaacacgaacatgatcggcaggacatatcgtgcgctggtgtcggaaacctcggcagacggatccgtcatagcgcgtacggggaactaccgccccgtcgtaataaaggaggatatcccccttggaacgttcatcaatgctacggtcacggactgccgccccacatacctccttggaaaaagcacttgattttaatagacgaacggaataatcgtcaacacagtcctgtagtgtagtggtcaatcatgctggcctttggagccggtgacctcggttcgaatccgggcaggactaccattattatccattcaggaccatgctggaaagatgatccgcatatacaccaactccgaaggaggtatcgtggagaccgattcccccggacctggtacatggaccaggataacggctccgacggatgaagagctccgtacagaatccgaaagatcgggcatggacctatccatcctcaccgctgccacggatgcggacgagatctcccgctgggagccatacgatgaaggcacatgcatgatcgtcgatatcccatacatgcgggatgacggtcaattcgatacgctgccgctggctatgataatcacaagagaccgcatcataaccgtatgcaggatcagcagcgggatccaagaacatttcatagagaccaataagaacctggatctcgacgacagatacggattcataatccgccttcttttcacaatatccaaaacatatcagcaggatctgcgggagatcaatctccgtcgtaagaacatagaggaaaagatagacgacggggttgacgacaaagacatagtggccatccacaaactggaaaacagtctcgtctacttcgtcacatccctgaaaggatgcaacatagttctggatctgataaagcgtaactcggaggagaaactgagcaaacagaacaaagagctcctccgcaacgtagtcatagagaatcaacaggccatagaaatggcatccatatatcgcgaggtcatgaacagcacgagcgggatgctctcatccatgatgggaaacagactcaattccaccataaggtggctcacagtgatcacgttcctcctgtcgatacccatgatcgtatctgggatctatgggatgaatatcgatctcccgggccagaacgccggatccgcgttcatatggctgatgacggggatcatactgatctgtctcggcacgggagtttggctgaaaaagaagagattcttctgaacaaaacttctttttaatattttcaaagaacgagtccgataaggaatgaatgctgaaaaacaatgacaagaattatggaaatgggcgttcgatgctacgtttagtgcgtggcaagctgccaaggaactgccgagaaaacctttacgattttccttgcaattatttgcgctttatatttgttgagggttgggccgaagcccaaccctgcgtaggaggtgatccatctgcaggttcccctacagataccttgttacgacttaacctcccttgctgaatctcagctcgaataccccaataaaaggcagcctcactgaaacccgactcgggtggtttgacgggcggtgtgtgcaaggagcaggggcatattcaccgcgagtttttgattcgcgattactacggaatccagcttcgtgagggtgagttacaaccctcagtccgaactacggacgggtttggagattaccttcacctttcggtgtcggaactcattgtcccgccctttgtagcgcgcgtgtagcccaagagattcagggcatactgacctaccgttgacctctccttcctctgacttagcgccagcggtcccgataatgtgcaccagatccggagatctagttagcaattataagtgagggtcttgttcgttatctcacttaagagaacgctttacagtacgaactgacgatggccatgcaccacttctccaagaatcaagcaaagtcattagcctggctttcatgtgatggtctcccttggtgagttttccggtgttgaatccaattaaaccgcacgctcctcccgttgcggtgctcccccgccaattcctttaagtttcatccttgcggacgtactccccaagtagcagacttaacaacttctctccggcactgaatgcccccgaagggcctccaacaccaagtctgcagcgtttacaccctagactaccggggtatctaatcccgtttgcgacctagggcttcgtccctcaccgtcggattcgttctagtaagacgccttcgccaccggtggtcctccaaggattacaggattttacccctacccctgaagtacctcttacctctcccgatcccaagcctgacggtctcctcggaattcggaaggttaagccccccgatttacccaaggatctatcagaccggctacgaacgttttagactcaataaaatcgaccaccactcgggctgcgggtattaccgcggcggctggcacccgtcttacccagcccttattcctctagttatctacgctaaagaaaagctaacacaaaagtgctagcactaggaattccctcatcgggctttcgcccattgtgaagttttcgcgactgctgcgccccgtagggcctggattcgtgtctcagaatccaactctgggctccctctctcaaggcccatacccgtaataggctagggggtacattacacccactactacctgataggccgcagaccgatcctaaagcgccggaactttgaaccataagtcattccagatctcatgatctatggggtattatccagagtttcccctgattatcccccactttagggcacgttgtccacgtgttactgagcagtccgccgagcttgcgctctcgactcgcatgtcttaatcgaattcctatagcggtggccgccggcaggatcaaccggagtcaaatcttattgactttaatcgtcatcagatgaatgaaacttgaaactggcagtttaccacgtttcacctatgtcccgtgacggcacactcttagaatgtccgttttcacgagacattcgtagcatcgaacgtcagagctcaagagtgcacgcccgaaggcggagatcttggctctccatattcgagaacacttgtttgtttgaggttgtgttctcgcgcattccccagtatacaggggaagtatataagccttttcatccgggatgtttttcgcattccagatgcacggtacagtgtcacctgcaaaccctcggaagggatgcggcggttgcatcgtgtgaattccctgattcctaggtagtatttaatacttccgaggaagcagttgcttctcctccaatccaccgtttccggctgattcaaggtaatccccactatatacatctagtatataaatatttctaaaacagggaagattgtccgaatcttatacggatctgccagaatttccaaacacatcccatatattataatgtatagaacgatgaataataataagtaaaattgaatgtaatctcccgaaaaccgccttttgacaacccatgttttttaataggattacgcattatgcgccgacatacgtggaggtggcccagcctggtaaggcgccagactgctaatctggtgtccgtaggacccgggggttcgaatccctccctccacgccattattctacccaattgtatgtaaacactgcatccggcgatcgatatctatgacgagtcttattccaaatggatgggcatcgtcgattttatcatcatgtgtctgttctacaggcatgatgacgtgccatacagaactccgcgattccatcgtcgaagcggtgaagacgaatgtcgaaggaaaagatgtggcagtcgcatgctccgggggactggattcgggactggtatccgcacttgcaaaaagatatgcccgctcggtcaccctgtacacatgcgggacctccaatgcattcgatgtcgccatggccaaggatctttccgaaaagatcggactcacatggaaccatgtacagatatccaagagcaacatatgcgacatgatatccgaactggcattggccggcgatacggacgatgcgttcacgatatcctacgaactgcagcttttcagcgtctgcatggcagcaaaggaagacatcgtattgtcaggacagggctccgatgaatacttcatgggctgtgcgaaattcgtcggggcatccgatgacgaatacgccatcctggtagagaccgccaaacagaggctcaacgagatatccgtgccttgtgagaagaagatcgcgaaacatttcggaaagaccctcatatatccgtatttggaagactcggttcgcagcaggatagacgacatcgacattctggagatgaaaccggcagacatgtcgtcccgcaaatcggtcctcaaggacatagcgagggacctcggatacggattccttgcagaaagggtgaagaaatcctcgcagtacggctccgggaccacggatctgatacgcggattggccaaagaaagaggcatggagtataacgaattcatagattcgatatgcgaggatgcgttcaaaggcaaatccaagatgatccgcggatcgatcgtgacggccagagtggaccccatagtaaaggcgaaggccgaagacatactcggaagacagggaatgaaaccctcggaagcgataaatgtgctgtatgagaggataatcagagacggaaagttcctctgaaaggagctgcactctatgggaaggagaccggaccctcgtacggaaagcaccaagatgcgtataaagaaagcattattgaagtatctctgcgactctcctttcgagagaataaccgtcaaaaacatctgcgattccgccggtatcgaccgcggcacgttctacacccattacagaaacctctcagccaccctcgacgagatcatagacgaggctctggaagaagagccttcaaggaggccgtaccgctgcacactgacggatgggcaatacaactgtccgtatgggatatgcgacaaggtccgcgaacatccggagtatggtgcggtgttcttcaacgaatcgctgacggagaagatcatcgacaggatctcgtcatattcagaggcgaaatacgtcgcatccctgacccatcaatgcgacctatctccggaacaggcccggacactcttccttttccagctcaacgggtgcctcgccatcaacagggccgcataccgcaaaggggaaaaggactgggaggagaccagggacctggtcggcggattcatacaaggcggtctcggccgctataagaaatgatttcatccacagattcgtgaatgtgtctacttaaaaatcagaatctttaaatcggcccgcctgcagacattattcatattatattaagagaggaaaacgaatggatctgatgggcaggggacagcccatattgatcatggccgccgcgatcatagggatcgtcctgggagacgtcacacccctgggtgccgcaccgtcgacggccgtagagatattcttgatgatgctcctgttcgtcctgttcctgtccgtagacctccgcaaggtgagcggatccttcgccaacatacgtttcaccggtgcggcacttgctataaatttcctcttcacaccggttctggcatatctgctcgggatcatattcttccccgactccgtcgacatacgtatcggtctcctcatgctcctggtcaccccgtgtaccgactggtacatagtattcaccggcatgagtaaagggaatgtggagctgggtctctccatcctgccgcttaatctcattctgcagatcgtcctgatgcccgtatatcttctggtgttcataggagacggtgctgacatgcatacggcgtccctccttgtcgacatggccgtggtcctggcggtccctttggccgcatccctgatattcaaacgcgcattcggaacccacgaaaggatctggaacgctctgtccgagaagggggaccatcttcaactcctgttcctgtgcctggcggtcgcggtgatgttcgcctcggaaggagacacgctcatggacaaccctgcgatgctgctggaactcttcatacctctcctcatattcttcacggtcttgctggcagtggcacaggcgatagggagaggtctcggattcccccgcagagacatagtctcgttgaacttcaccactttggccaggaactcgccgctcgcattggctatcgcagtcgccacattccccgacagcccgttgatatccctggcattggtgatagggcctctgatcgagctccccgtactgtcgctgatatcggccgcactcctgaaatggaatacgaaagaaggtccgaagacatcggacggctgtccctgacacatcacaggtattggaaaataattttatttgatttatcaatatattctgatatgagcgatttcgacaggctctgcaaagaattcgagaagatggaccccctcacctactctgctgtaataaaagagaagtccgtcgggatcttgaccgcactgtccgccatcaccaagaacgggatggacgggatgaccatctatgcggacttcatcctctgctcgatagcggcagacggcaagctctccaaggaggaattctccgtcctgcaaccatccctctgtctcctcatggggaaggatgtgacatacgaggatgccagatccatgttcaaggaactgggactcgacagatccaaggattacaaggaagtcatggacctcatggtcgacatcctgggtctcgtatcccaggaattgaaggatgacataataacggtctgcatgatggtatgtgcgatagatggaagaatctccttcagagagaagagatggattagacggcttattgaatgaagagagaccggccctctccggcaatcatgatatatgtgcatgtttattcaataaacaatgtaggatccggggcggaacagggcccctgaatgccatgtcggaccacatatcccccggtatcgtatccacgccccggaacttacattgaccccgtatcgaaaacggcatcccttgttccgcagaatggggatcaaggctgcacatagccgttcttcattttactgacgatgttcttcagagcctccagatcttcctcggacaacgcctccacggtggccgtggcggcctcgctgatcaacctggtcatcttggaataaagggcctttccttcggcggagagcgtcaggagggacttccgtttgtcgacggcggtcagaacgatatagtcccccagattcttgagggtgttcgtgatcatcgacctgttcacccccatcaccttggccaggtctattttggatatgccgctcttgtggataccgatctcgcgtatcatcagagcctgtgcgacggtaaggccgtacggctgcattttctcaccgaaatccgcggagaaacgacgccacgattccagagccaacgttatgaaatgttcggcatctgccatcttatcataatggcatctgcaccgatgttattaatcctctgacgaaaacccgtacagataatggataagtatggtataatccataccgtgtcgtatgaaattcctggtcatcaccgacctccatcagaaggcctccaacatcgaatggataaacagcatcatcgagaaagagaaccctgaaggcgtcctctttctgggtgacgtcacggacatggggacggcaaacgatgccgtagagatcgtctcctccataaagtgcaagacatacgtccttcccgggaactgcgatccgcgcgacctccccgacaaaataaaggccgtggccacggacatgcatgggaaaactgtgaaggtcggagactacgacctggtaggtctcggaggatcgaacataacgatattcggcacacccttcgaactcacagaggaggagatcgattccaaactgaggcccatatccaaggagggcatgatcctgatgacgcacgcacccgcctacgggacgctggaccacatccccaacggcaccagcgtcggaagtccggccataaggaagatcgtcgaagaattccatccgatagtcgcactttccggacacatccacgaagacatcggtgccaagtatatcgacgggacgcttttcgtaaaccccggcccggccaaggacggatgtgccgccattgtaataatcgaagataaacgcgcgtacgtgcgctttatagggccgttggaccctgcttaaaaggaataagcattaaatattggtctacgatagcaggggcgattaacatggcactatggcagggtaaatccaacaggaaatccaccggtggcaggctcgtcctcgccaggagcaagagaaagttcgagatcagcagagagaagcagtacaccagacttggaactgaatccctcaggcagtaccgcggaatgggtggaagcgtcaaggttggaatgctctacgccgagtacgcgaacgtcgtggacaagaagaccaacaccaccaagaaggtcaagatcctcaacgttaccgccaacccttccgaccccaacttcgtacagcgtaacatcatcaacaagggagctaagatctccaccgaggccggagacgccatcgtcacctccaggcccggacaggatggtgccatcaacgctgttctgatcaactgatcggactgacgttacttacccggggcctgcccccggggccacttttccaacagtttcctagcaattgattttaaccagattccgcatacgtcggattgatctctatggcttacgatgacgacaccgcaatcgttctgtggcccgagtatttcgactcggggctcacccgcgctcagggaagaagacttccgacggcactttgcgtgaaacagccttccttggacatgatcgcaaagggggcgatactcctggatctggaatatcgcgtcatcgaagacaagagctatccatcggattggccttctaaacgcggatgtgtgcgcgtagagaaaggtaagatgaaaaaatccgagatcctccccaagatcggcgagatcctagtaaagaatcagaagtgagcataatgatctcatcgctcgactcgaaggtcatggatgccaattccgaggccctcggaacgagtgttctgacccttatggataatgcaggcaaagcggtagccgatctcctgagggaaagattccacggccaacgcttcatcatcttctgcggtcatgggaacaacgggggcgacggattcgccaccgccatccaccttgcagaggaagatgtgagcgtatgcatcatcggagatccgtccaaggttcgccccggtgcagcatccacatatctatccgaactagtatgccctgttgtccaattcgatcccaacaacagagactacgatgttctggtggatgccgtattgggaacaggaaccaagggaaaactgcgtcccgagatagaggcatacatcgactacacccgtaaattccaaggacccatcgtctcgatagatgtacctacagggattggttctccgaaaagcgtcatacccgatattacgatcaccatgcacgacgtcaaggaaggcatggatgagaagaactccggagagatagtcgtggcagacatcggcatccccgagaaggcttacacccacacaggccccggggatctgtatagatatccgataccgacgaaagacagtcacaaaggagcgaacggaagcctcctggtaatcggaggggggccgtattacggtgcccctgccatggcggcaatggcggcaatgcgtaccggagtcgacctcgtcacgatagccacccctgaatccagttaccacgaagtggcggcacagtcccccgtgctgatggtaagaaaactcagagggagcaccttgtgccatgaccatgtcaaagaacttctgaaaatgtcggaagtctgtgatgccgtgttgatcgggccggggctgggaagagacgaacatacattcgaagcggtaaaggaattcgtatccctatgcagaaaacccctcgtgatagatgccgacggattgaatgccctcggcaccgatttcaacgccaaaggtcctcagaccgtcctgacaccgcattccggagaatatctgcgcatcggcggaagttccaaggatccagaagatgtgaggaagacctcatcgagactcggatgtacgatcgttctcaaaggaagatatgacatcatatctaacggagactctgtaaagatcaatggcaccgggacaccgggcatgaccaccggcggcacaggcgatgtgcttgcagggatcatcggaggcctattggccaagggcatggatgcatatgaggcgggatatctgggggcatacatctccggaaaagccggagaattggcattcaataaattctcctacgggatgattgccaccgatgtcatagatcgcataccgaaagccttgaagaacggtttcgaccgcctgggactatgacggacctgcaacccgttcccggaatccccgcactgaagatcggggacacgctggtcataggggatctgcacataggggtggaagcccacctgggtgcaaaaggcatccacctgacttctcgcacagatacgatgttcgatgcggtcatagaggccgcaggcacagatgtagaccggatcataatgatcggagacataaaggactccgtacccggatctacaagacaggaatatcgggaaatcccgaacttctgcgacagattgctcgaacatttcacagaagtatgtattgtgcgcgggaatcacgatacctccatagaagaattcgttcccggagccgtacgcatttatccagctacgggaatgagcatagggaatataggactcatacacggacacacgtggccatcggaacaggtaatggccaagaaaacccttgtaatgggacactgccaccccacagttcttttcaaagacggtgtcggcgcacatatttcggaaccatgctgggtcagaggaagattcacagtgacggaaaacgaaagatatccgattcttcctgaatcattcataatagtcccagcgttcaacagaatgctcggaggatcaccggtgaatgccataggcacgcccctcctcggaccgataatgaactcagacatcgtagatctggaaaatgcccgcttataccttcttgacggaatagatctggggagaagggaaaccctcatggtaaaggatagacagttcaaaagatggaacgatgatgagaattcccctcgtcacagcgctctttgaccttttagatcatcgctgccatgatgcaacttacgagccatctcgatcataaatgatcgaaaaagttcagcggatagctccgtagaacatgataagggggcgggatggagaggaccgtcccctaaaaagttttgatgataagggggcaaaagcccccgttttgacatcagttcctggtgatggtgtcgtagagcgaaccgtctgcgttcctgatctcagcagtaagcggcatctggccgggcaggctgtgagttgcgcaggagttgcaggggtcgtatgccctgaaggccatctcgaccatgttgaggagaccgggggacacatcatagttcttaatgagtgccttggcgaccttagcgacatccatgcagatgggtccgttgttgttggtggttccgacaacaaggttgcaggcggtaacgattccgttctcgtcgcaagtgtagtcgtgggtcagggttccgcggggagcctcgacacatccgacaccgcgtcctccgggaacgaggtcgaactgcttgatgttggggtcggtcagcttgtcgctgtatgcgtcctccttcagcttctctgcggcatagagcatctcgatgatccttgcccagtgggttgccagagtgtactgcacaggctcgcgtccgacgactccgagagtctccctgtactccttgagggcctcgttggccagaggagtggatatgctctcgcagacattcagcctggagagaggagtggctctgtacagaccgctgtcgggtccgtcgacaagtcccttgtatccgggtttcttcaggtacgggaacttctcataggaccagggctcgacggcctctccgatgtggtcgaggtagtcgaaggaatcgtacttgtcgcactcgtttcctttctggtcgacgacacgtacctttccgtcgtggaactccagctggttcttgtcgttaacaagtcccatgtggtaggtctcgtggtagtagaggtccttgttggtgatgatgtctacgtactctttgttggagaggacgacatcgtggaacaccttaagggaagtctgggcgaactctacgagtccgtctgcgtatccctggatttccttcgcctcttccttgctgatggctttgctgactcctccggggactcccatgagagggtgggtcggctttccaccgatgatcgcctgtactttctgagcctcggcacgggccttcagaacagcggatccgagctcgagtccgacgttggcgacgacaccgagaacgttcctctgcgctgcaggtgctgcaggtccgcagacgaagtcgggtgctgccagtgcgtagaagtgtgcgatgtggctgtgtacgaagtgcgcgtggtagaaggtgtccctgatgtggaacgccgcctcggtgggcttcgagttgtagcatccgtcgatggccttggtagccgcgaggtggtgagcaccggggcagacaccgcaaagccttgcggtgatctgtgcgagctcggtaaccctcctgccgatgcagaatctctcgaatcccctgacctcggggacctgccagtatgcgtttttcacatttccgctgtcgtcgaggaagatctcgatctttccatgtccctcgagacgggtgatggggtcaacggtcactctgttgccggtgaccttctgtttctcatcccaaatgataggtgctgccatttgtcttcctcctttaagcggtcttctcctcagagacagacctgttgatcagagactttccgagagtgaatgcatagaagtatccgagggggtccttgatggtggacatgacctcgatgatcttctcctcatcacaggtggggtcctcatccagtacggggaacagggatgcgatggcgctgaaggcgctggatccgtggtcctcgacgaagtgggtgggtccgtagcatccgcggcacggctggccggcgcgggtacactttgcgttgcatcctccgacggtcgcaggtccgaggcaaaggattccctggtccatgaggcacttgtgggggtcgacgtcgacctggtagggctcgtagatcttggtgatccttgcataggccttctccctggggcactcatcgcagagacacttctcggtgactccgatctcggttcccttggggggcagggcgactccgttgtagacgaagtcgacgacggccttcagcagatgggagatggactcctgcagcggagggcatccggggatgtagtagtccacatcgattacctggtcgagggtctttacagtgtcgtatagcacaggcagggtgagggttccctcgggtgcctgatactcggactgggggatgacgggtgcatccttgtggtagtccgcctggaaactggcgctggacggggtcttggtgtagacatagtccaggacctcctggcttcctccgttgaccaggttggccagggcgggacttccaccaaacatggcgcaggttccgtagcagacgacgatcttggacttctgcctgaggagcttgaccatgtgctcgttctcggtgttccttaccgcaccgctgatgatggagacggtgatgtctccgtcgttcatcgctgcgatgtccttctcttttccgtcggatgcgataggccacatgacgatgttggcgaactgtccgatggtcaggacacgctcgttggtgtcgagcagggatacgtcgcatccaccgcaggctgccgcccagtagatggcgaggttgatctttccgccgctgggctctgcagggagaagctccccgaggtccgctgcaggatactcgacgtgcccctggttgaccggggtcgcggtggccgctgcgtctgcagcgggtttggcgacctcggtgttggagaaggcgtccttcttgttctcgcaggcgcactccttctttgcgggtgcggcctttgcctcggcgcactcggcctcggcctctttcttgtctttcttcttgaataggttggagaagaatcccattttcatgcctccttgacggcgtgtgctgcggcgttctcttcctgtgcaatcgtctttgcggacttgacgggggtaggcccaagcgccttgatggtgtcgatgaaggacaccatggtcgactggaacttctctccctcggaagcggaaacccactcgagcttcagcctcctggggtcgaatccgtactgctcgaggacgagcctcagcagtgcgatcctcctccttgccctgtagttgccgccgatgtagtggcaatctgcggggtggcatccgaggacgatgactccgtctgctcctttggacagtgccctgaggacgaagtcggggtcgatccttgcggagcacatggtcctgatgatacggaagttcggaggcatctgacgccttccgactccggcgttgtcggctcccgcgtaggagcaccagttgcagcagaatgcaacgatcaaaggttcaaattcgtctgccattgatatcactccttctccatgagaggtgcgtcaaacagagcgtcgatctcggcggtgatctgcttgttcctgaatcctctctgctccattgctccggacgggcatgccgcgacgcagcatccgcatcccttacagagaccggcgttgacctgggagataggccttccctcgggggtcaaggtgatgctgatcgcgttgtactcgcagcatcctacgcaggttccgcatccgttgcagacctgggggttgctgacggaagccacgataccctcggagagcaggtggtccttggtgatgatggtgagcatcctggaagctgctccggatccctgggcgatgcactcgtccatgaacttgggccagtgggctgctcctgcgacgaagactccctcggtcgcgaagtctacgggcctgagcttctggtgggcctcgaagtagaatccgtccttgcttatcgggaccttgaccatcttggcgaggtgttccttctcctcgcgcatcggagcgattccgacggacagggcgagggtgtccacggggatcgatacggtgtcgccgaggacggtgtcgtacgccttcacgaagttgccgtcgtactcgggcagctggtcctcgcactcgcggcggaggaacctgactccgagctggcaggccttgtagtagaggtcctcgcggaaggagtaggtcctgatgtccttgtggatgatggtgacgttggcggtcgggtcgttcatcttgatctggatggcgttcctgatcgcaccggcgcagcagacacggctgcagtagccgaccttctcgttcctggaaccgacgcactggatgaagacgacgttctttccggtgaactttccggaagcgaccttcttctcgagctccacataggtgaggaccttggggtcggaaccgtagttgtactcgacaggctggtactgtgcggatccgactgcgaacagaacggctcctgcggggatctcctctccgctcttcagcttgacgacgaagttaccgacgtatccggggatgtccacgatctcggccttggtgtagactttgatcttggggcagttctcgaccttcttgatggtctcggcgaggtactcggacacgagctttccgtcctccttgtggacgaagttcctggcgaatcctccgagctgggagtccctctcgaagaggttgacctgtacaccctgggctgcgatgtcgagggcggcggtcataccggtgattcctcctccgacgattgctgcggactgggtgacggggatctctgctccctcgagaggctcgaggaggcatgccttggcgattgccatccttacgaggtccttcgccttcacggttgcggcctcgggagagtgcatgtggatccacgagcactggtcgcggatgttcgccatgttgtagaggtacttgttgagacctccgttcctgcaggcctccctgaagagaggctcgtgggtcctgggggtgcaggaggctacgacgaccctgttcaagtcgtacttggagatggcctcgctgatctcgttgagggtgtcctgggcgcaggcgtatttggtctcggctgcgaagacgacgtgcgggagggtcttggagtactcggtgacctcggggacgttgacgacagatccgatgttgataccgcagtggcagacccatactccgatgcggggctcctttcctgcgacatccttctctgcggggtagaccttgggcttgcaaggctcgaactcggggtcgttgacgatgaacgcaccggcctttgcggaggcaccggatgcctctgcgacggaggtcgggatgtccttgggtgctgcgaaggcaccggtgacgaagactcccttcctggtggtctcgagcgggttgaagacggtggtcttggcgaatccgtactcgttcagctcgataccgagggtcttggcgaggtctgccgctccctcaggaggctcgagtccgacggacaggacgaccatgtcgaaggtcttggagcatgcgtcgttgttcttgtcggtgaagttgacggtaaccttgtgggtctcggggtcctcctcgacgttggacacacgggctcccctgtgcatgtggattccgtactcgtcctcggccctcttgatgtaggcctcgaactcctttccgtaggacctgatgtccatgaagaagatgtcctcgtcgacatctccgtgctctttggtgatctgggcctgcttggtcgcatacatgcagcagacggacgagcagtaggtcttccagctcttcttgtgggacctggaaccgcagcactggatccatgcgacggatttgggtccgacctctccggcgtgtttctggggcactccgaacttgtccttcacgatggtggagggtatcgggatgtgtccgtcgaacggtcctgccgcaccctcgagcctctcgtactcgagagcggtgaccacgttggggaacctgccgtatccgtactcggatccgttcttggcgtcccataccttgaatccggcggcgacgatgatggaaccgacgttcagctcgatgatctcgtccttctcatcgtagtggatggcctgctttccgcagaccttggcgcatactccgcacttgccgtcgaggagcatcttacacttagaagcatcaataagggcgaccctgggcacagcctgggcgtgggggatgtagattgccctcctggtggaaagcccgtactcgaactcgttcgggattcccctggtgggacacttggcgacacagtcaccgcaagcggtacaggatttgggatctacgtaccttgctttcttcaggaccttgacggtgaagtttccggcctctccgaggacctccttgacctcatggtaggtcagaacggtcacgttcgggtgtccggcgcagtctgccatcttaggcgacaggatacacgccgagcaatcgttggtcgggaaagtcttgtcaagcatgcacatcgttccgccgatggtggggagtttgtccaccacatagacgtggatgttcctgtctgcaaggtccagagcagcctggattccggcgattcctccgccgatcactagtgcagatttggttgtcaattcattacctccgttcccaattgttggttggaatgaagatagaatacgaacgagttattaaaacccttattaaataaaatttaaatatatagattgtatttaataaggaacttaaaaattcaaattaaattttaaccatacaatttttaggttaaccgaatatattatgtgccagcaatcggattgactgtaaaaaatcagtattatctaaaaaggcaaaacaacttaatttttagtaacatccatgtatacgaaattataaaatcgtatgcatttcaaaatatacctaaattttacaacggcaaccatacataccgaataatttatctattgtaggatgtgccgactaaaaaaccaatccaatctggcacattccaatcctgaggaaaaccgccatccattgggaaaaaccatccatccagacgacatttttcgaaccgggcatcatctgcggattttccgcccgtcgcaggtccagacatctgcttacaactatcgtttttgtcggaaggacaggacatggaggcggcgggaggaatgccaaaagtttaatcccaacagacattcggtccagatgagatgaccgtcaagtcgaaacgcggaagacgcagatacatcgcattcgtcacatcgcccgggatgacgaaacagaagatggtcgaaaacatccccggcgggaagacgttcaacatcatacagtgcgcggaagggatggcgatcgtccgttgcagccccaccaacatcgaacagtgtgaaaaagcggtgaggtcctgcgacccgacagcatatgccgtcagaacatctggcactctgcgtacactgcgtgacggatactcggtcctcaagaggaacgcacctccgaaacctccccgcaaaggcgtgcctccggccagacgctgagccctcttatagacacgcgtagaatcttatcatcgccattatatagtgcccttgcattccctcgctctaagaggaatacgcaatgcaaccaggacaaatggcatatgatcggggaatcaccgttttctcccccgacggaaggctgttccaggtggagtacgcccgcgaagccgtcaagaaaggaacgacgactatcggaatcaaattcaaagacggcgtgctgctggtcgtagacaaaagggtctccagcagacttgtggagcccgagtccatcgagaagatctacgacatcgacgattacatcggctgtgcgacgtccggtctcgtcgcagacgccaggatccttgtcgaccaggccaggaaagaagcccaggtccacaaggtcaactacggcgagaacatcggcgtggagatgctgaccaagaaggtctgcgactacgaacagaactacacccagtacggcggggcaagacccttcggaaccgcccttctcgtggccgggtccgacgacctcggcacccacctgttcgagaccgacccctcgggagcgctcgtcgcatacaaggcgtcctgcatcggtaccgggcgccccgtggtcatggatatcttcgagaaggacttcaaggacaacatgtccttcgacgccgccctcaaactcgcactcagcgccctcgcctcggccatcgaggagaagctcaaccccgagtccatcgagatcggggtcgtcaagaccgacgagaagttcagaaggctcaccggcgacgagaaggccaaggcgatcgccaaggccgaagagaaggaaaagaaggcaaaggccgcggccaagaccgaggaatgagccaccatggtagacctcgacgatgcgatcgtagccaggctggagagccacggggagaggttcgagatacttctcgatcccgccgccatggaccagataaagcaaggcaaagaggtcgacctggggaaatatctcgcggtggaagacgttttcaaggatgccaggaaaggcacccgccccgccgaggccatgataaaggaggtcttcgggacagacgatatcgtggccatagcgaagcatatcatcgagaaaggggaggtgcagatgacggccgagcagcgcaaggaactgctcgaggccaagaggcggcagatcatcacgtacatcgccgccaacgccatcaatccgcagacgaagcttccgcatccgccgactaggatcgagatagccctcgaagagggcaagttccacgtggatcccttcaaaccattcgacaaagaggtggaggaggccatgaaggtcctccgtcccctcctcccgataagattcgaaaagagcaggatagcgatcaagctcaaaggggaggactatggccgctgcatcgaagagatgaacaaatacggcctggtcgacagggaggaatggaccgccgacggctcctggatcggaaccatggagattccggcgggactcataaccgagctgaccgacaaactgaagaacaggacccacggaagcgcgtccgtcaaactgatgggcgcctgattttacatttcagagtgtgatacaatggaaaaaagaaacgccagaaggacacgcgagatcgttgtccccggagaggtgctcggcgacagcgaagagtacaggaccggagagaacgcatacgcatccgacggcaagatccgcgccctcgttatgggactcaagacctatacgggcgacgcggtaggcgtcatccccatgggcggatgctacatgcccgtgacaggagacaccgtaataggaataatcgcagacgttggaccttccaactggatgctggacataaatgcaccctaccctgcacccctccatgtgagcgaggtgccgtggaaggtcgagttcggagatacctccaggttcctgacggtaggggacgtcgtcctcctgaaggtcctgatggtggacgaggcgaagaagatctccgtcaccatgaaggactccggcctgaggaagatcgagggcggacagctcgtcgagatcgcacattccaagatctcgagggtcatcggcaagagcggatcgatgatccagatgctgaagaacatgaccgactgccgcatattcgtcggtcagaacggaaggatatggatcgacggcgacgacgagaacgtcgaggtcgccgcagaggccataaagataatcgaggcggaggccaggtccgccaacctcacggacagggtcagggagttcatagagaagaagctcccccagtccgaggaagaagaggacatcgaggaggaatccgaatgagcggacacacagacatggtattggttaacgaggagggcatcaggatcgacggccgcaggaccgacgagaaaaggcccatccgcatagaagcgggcgtattgaagaacgcggacggctcctgttacctggagatcggaaagaacaaggtactctgtgcggtctacggacccagggagtgcagacccagacacctgcaggaccccaccaaggccatcatccagtgcaaatacaacatggaggcctactccgtcaccgacaggaagagacccggtaccgacaggaggtcggtcgagatctccaagctcatctccgaggccctgagcagcgtagtacagctcgaactgtatccgcgcgcatccatagacgtgtacatagagatcctccaggccaacgccgggaccagatgcgccggtctcaccgccgcatccgtcgccctcgccgacgcggggatccccatgagggacatcgtccccgccatcgcatgcgggaaggccgacgacaaggtgctcctcgacctcaacaaggaggaggacaactacggacaggccgacgtacctctggcgatcgtgccctccaccgacgagatcgtcctgctccagatggacggtaacatgaccagggaggaactcgagtacggccttgacatggcgttcaaggcggcccacgaggtcagcgacatccagaaggatgcgctcaggagacgctacacggagatatccaagaaggaaggtgagtccgatgagtaactacgtgatttcgcagataaagagggaccacctcatgaacctcctcgccgacggcaggagggaggatggaaggcagctcgacgagatgaggaagatcaccgtcgagaccggcatcatcgaatccgccgagggatccgcaagggtccacctcgggaacacggacgtcatagccggtgtcaaggtcatccccgggaccccttacatggatgcacccggagacggggtactcaccacaggtgcggaactcatcccgctggcacacgagtcgttcgaacccggacccccgagcgaggacgccatcgaactcgcccgtgtcgtggaccgtgggatccgcgagtccgggatgatcgacgtcaagcagctgtgcataaagaaaggcgaggagatctggatggtgttcatcgacatctatgccctcgactacgacgggaacctgttcgacgcatcgaacctcgccgcggtatgcgcactcaagaacgccatcgtcccctggaaacagtatgggaagagcaggaccgatgacgacggcaacgtgacggaaatggataatgtacccatgcccgtcacctgtctgcccatatcggtcactgaatgcaaaataggcaatgatttaatagtagaccctaatttcgacgaggaagcaatctccacggcccgccttaccgtcaccaccgataacgacgggaacttcagggccatgcagaaaggcggaaagggatcgatcacccgcggtgacctctcgctctgccttgatagagccgtcgagataggcaaacagattaggaatatcatcgggtgatttaaaatggcaaaaagaacagccaaagcaggaacagccggaaggttcggtgcaaggtacggagtcgtcgttcgcaacagggtgaagtccatcgaggcccaccagaaagcgaaacatgagtgcccccagtgccaccacatgtccgtcaagagggtatccgccggcatctgggagtgcaggcactgcggaaacaagttcgcagctgcggcatacagccccaagaccaagaagaccaccgacgcccttgtagccgccaaggcggccaagaacgccgaggccgcaccggtcgcagacgctcctgccgagcagtgatccggactggtggtccgaatgtacagatgcgcaaaatgcaacgaacccatcaggaacatgtccccgatcgggttgcagtgcgacaagtgcggatccaggatcttcgttaaggaaagacctaacgtgaagaagatcctgaaatccgactgatatgccgacagcagtcctgagtatagattccggcaacgccggaacggtcgcctcggcgatcggaccggaggcccgccgcgaccttctcaggacccatgtcgacgtgagtctcgaagacggtaaggccgtcataaggatcgaggcagacgactcgtccgctatgcgggcggctctgaattcgtatctcgagtgcataatgatcaccgagaacatcgacaggattacgaagggttcaaaatgaacggaatcagcccccagctccagaatcagatagcacagtaccagcaggtacagcagcagctccagaacgtcatgacccagaagggacagatggaatcccagcagagggaactccagaggacggttgaggagctcgccaaggccgacggggacgtgtacaggaacgtaggaatgctcctgataaaagtctccgacaaggccgccctgaaagacgagctggaggagtccttggagaccctcggcatcaggataaggggcctcgagaggcaggagaaagacctccgcgagaaatacgaggtcctcggagagaccataaacagggctatgggaaacgctcccgtacccaaggccgctcccgcaaggtccgacgacgaagaagactgaaacatctcaagagggctcgcatagccctgccctcttcatactttttataagaatagttgaatgagccacctatgacagatgcgctcatcctgaaagacgtgcgcaagatctatggggaccgcgaagccgtcaaagggataaacttctccgtaaaggagggggagatcttcgggctgatcggaccaaacggcgctggaaagacaacgaccctcagaatgatctgcaccctcctccaagtgacggacggaagcataaccgtatgcggacacgacgtcatgaaagaggcggacgaggtaaggaagataatcagctacctcccggaggactccggagcctacaaggacctcacaggacgccaatacatacgcttcatggccgcattcttcgcggatggggagaagttccagcagatggtcgacaagggcatagagatgtccaatctcggcgacaggatagattcgaaggtcagcacctatagcaaagggatgatgagaagactcctcatcgcaagggcgatgatgccggaaccaagactggccatcatggacgagatcacctccggattggacgtcatgaacgcatatgagatcagggagatcgtccgcggtatagccaaggaaggtgtaaccgtcctcatatccagccacaacatgttcgaggtcgaaagcctctgcaaccgtgtggccatgataaaccacggagacatcgtggaatgcggcacccccgcagaactcaaagagaaatataatgcgaacaacctcgaagaggtcttcgtgaaggcggtgaggaaatgaaccatctggtaaatatcaccaaaaaagaactgagggaactcctcacgcccggggccatcctctccgtcgtggtcatcatggtactattcatgtgcatcgggacggccatcggaggcgaggcggagaagtccgcttccgccgcgaagataggggtcgtatacaatgcaggggacggagcgaatgtcgcagagacctacggggatctcgacgacccgtccgagataaagctgctggtcctcgactcatatgcatccctgtatggaatggacagggatgcggcctccgcatccatacagtatctggaagtgggttacagcgacgaagacggcatcatctcggcaatagaaaggtacggattgtcttatgtcataaccatacccgattccatagtgaccaacatcggtaagatcaagaccatggcccccgatgcggaattcacccccatcggcacatatttcgtgtatgagaacgaagggctcttcggatccgcatccagttccgtggggacgtccctcgtaagcgagatgaacggaaggctctccaacatactgatcggcggggagataacgaccgacacggtctacttcatccagcctctcatatggggcagcgaaaacaaccacacctacgtcaatggaacgatctactcggatgtcacaccctatgcgttatccagctccatgaccagccagagtatgatgatacccctggtcgtgatgatagtgatcctcatggtcggaagcgtggtcatatcgtccatgggaagcgagaaggagaacaagaccctcgagaccctcctcaccatgcccatcaagaggaccaccatcataagcggtaaactcctggcggcggccatagtcggtctggtgtacggagtggcctacatgatcggaatgatgttctataccaccggactcaccgtgggatccaccagcgtcaacctgtcggagtatgggttggccctcgatgcggtagactggatcctgctgatgctcatcctgttcctggccatattcagcgcactcggcatctgcatgatcctcggagcattcaccaagaactacaagatggcccagcagatgacgatgcccataagcttcctggccatcatccccatgttcgtgttcatgttcatgagctgggactccatgccgctgatcggtcaggccctgctgttcctgataccgttctcccacccgatgatggcgatgaccaacctcatgttcggcgatatgaccctcatattcggagggatcgcatatctgttgatcttcgacgccgtgatgatccttataaccgtcaagatctacaactccgacatactgatcacgggactggaccagacgaagttcatgaagactctgaacaagatgttcaagataaagaaggaagatcatgaaaacaactgaagcggccgacatactgagaggaaagaagaaggtgatactggtccacggaaatgcggacatggacgccctgggatccgcatacgctctcgcgaatgcgttccctccggcagacatattcgcacctgcgggagtggaccgcgtcgcaagaatggtggccgataaactgggtatgaaggtcttggaggattgcgatctttccgattatgaactcgtgaccatagtcgacacctcgtcgcccgatcagctgcagagggatctggcacttccttccgactgcctcgtcatcgaccatcatgcacccaccggcaaatgggacgggatgcgtttcttctgcgacgacacccgtgtagcatgctgcgagatcatcaaggacataatagagggcgccgggattggcatcgacaggaaatccggactggcactgattggagggatgcttactgacagcggccatttccaattctccgacccacggatgctgcacgagttcgcagaccttctggaaaaatgtcagatacctatggatgaggccctccaactcacccgtgcccccgtcaacatgagcgagcgtgtggccgccatgaaggccataggaaggtcgaagttcgacagggtgggggacatgatcgtcgccgtatccttcggaagcagcttcgaagccgcctcgtgcagagcgctgatggcatccggagcggacgtcgtgttcgtagggtcccagagggacgatgagttccgcatcagcggccgtgcgtcccaggagatggtccgcagagggataaggctcgacaccatactcggggacctcagccatgagaccgagacggacgggggaggccatggaggtgcagccggaatgaccgggatcggagatgccgaggcgatgctccacatgtgcatgatgaagaccatggacgagttcagaaagataaagacccagatggaagcggaaagccagtccggggatccttccgaagaggaccgggactaatccctccctgaaaactacaggcctttgggagagttcccaaaggccttttgaaattgtaagaccccgccgaggatcagcggagtttcttgacacttgccatgatggcactcatcttctcatagttctcggggaacttggagaagtaatccgccacaggcgccaataccttgtttatgccgtccacgataccttccttgaggtcgacgggactgagcctgcccccgaagtagtctgccgtgagctcctcgtaggtggcgtaatccacgttgccgccgtatttctccggacgctctatgtggatgttgttgaagcgcgggaagatgacgtaacgcgccatcatcagcatggggttctccccctccttctccttctcgggaggacagtaggccttcttgatcttctgcttcacggaagcagggtcgtcgtggatgtttatgctgctggtgggatcggacttggacatcttcatctcgatcatacactgggtctgtgcctcgatgccttccccttcggtcgtgcagaccttcttggtctgcagctccttgaccccttccggattcatcctggagcctcccttgagtccgggaagcaacggcgtgtggagtgcgagaggcttcttccacccgagtttgtccgcggcatcgcgtgcgagcatgtgggccctcctctggtcgatacctgcgtaggcgaggtctatgcccatgtggaacatgtccgtggcctgcatgagggggtataccaccttggaggaatccagctccgcctcgtcctccttccttcccatgatggtcatggccctcttcaccctggacagggaagtgacctttccgaccttgatgagcttctcccagtaatcgatgtcgtcgaggacctcgctggcgaacctgaattcgaccttgtccttggggacgccgagggccacgaaacagtcctccatgtatctggcacatgcctgaatgttctcgaggttcccaccgagtttgtcattgatgtaggcatgccagtccgcccagaggatgatgaccttgaacccggcatcgcagaggtccctgatcttggcggtcaccaaggcccaacccatgtggacgagaccggagggttcgaacccgatatatgcgagcggctgctccttggtcttcaagagctccctgagctcgtcctcgttcacaagctccatcgcattcctggtcactagggccatcctctcttctacgtccatattgatcgcgcccgagattggttttacctataataaaagaacgggattccggtccgaggactcgtacgctccaatcactttttaacgataggagcagataggagaccacatgtatgacaggctcgtcgagagtttcgagaaatgccccgtcgtggacaggaatggatatccgtatttcgtccacccgctcaccgacggtgtccccagaatggacccggccgtcctccgggatgtcctggaatggacaagatccgtgggagatctcgactgcgacatcctggcccttcccgaggccatgggcatccctatcggcgtacctctttccctggagctagggatcccatacaccgtcataaggaagaagtgttacggactccccggcgagatatcggtcgaacaacatacgggatattccagctccgtcatgcatataaacgacatccgcgagggggaccgcgtggttctcatcgacgacgtcgtcagcaccggaggcacccttgtcgccatgatcaaagcccttagggaacaggcgaaggccacggtcgtggacgtgatcgtccccgtggacaaggccggagggaagaacatagtgaagaaagagacaggcatggatgtcaagaccatggtggaggtctccgtcggtcccgaccgcaaggtacactgcagactgtgctgactgtaatatcgtgtctttttaaaccgggccctgcgttgaaatcgcgtgggtccggatatcgtgttattggtcctgtcggcaggagtcatcggagcggccatcggcacattcacagggatggttcccgggatccacgtaaacaccttggccgccatgatgctagcggcgtatcctgcgatagaggatgcgatgtccgggatgaccgaaccggaatacgtccccgtattggtatcgtgttgcatcatgtccgcatccgcggtgcattccttcgtggacttcgtaccgtccgcattcataggggctccggatgcggacgaggccctgtccgtcctgcctgcccaccgcctcctcctgcagggggagggcatggtcgccgtcagggccgccgccgtagggagcgcagtgggggcctcatccgctctggcacttgccataccggtccaatgggcccttctgcatggggcctcctcggtcctggacgggctgaccctgggcatcctggtcgtgaccgtggccgtgatcgtacttggttcggacgatcgcgtcgcatccctgatactggcacttgtttccggggccctcggcttcgccgtcatgaactgcgacataccttgtaaggggatagtggacggggggaccctgctgttccccctcctgtcgggactgttcggcatacctcctctcctggaaaggaccgccaccccccggatccccgaacaggtggaccggtgcgaagaccctgtgggtccatggccgggactgaagggcgtggtcaccggatgcatagcaggatggttcccggggataacggccaccgcaggggcgtccctcgcatcggcggtatccaaggaacgcgacccggccggattcatatcgttgacggccagcatagggacggttacgtccgtgttctccgtggtgacgctgtcggtatccggaagcggcagatctggcacatccttggtggtaaaggagatcatcggggacggcctcgccggcttctgttccgatgcattcatcctcatacttttcagcatcgcggcggcctcggccctggggtatgccataacgatagcggccggcaggctgatgtcccggatcgtcgacaccgtgccggcggaaccgctggccgacggggctctggtcctgatgtccgcactggtcctcctgctaaccgggccgtggggactcgcgatactggcggtctccgccttcgtggggatgcttccgcagaggttcggggtggccagggtctgccttgcatcgtgccttctgatacctgcgataatgacccagacggggatcgtctgacattgcggaggaatcagtaggtttaatacggccgcatcactaacctgattgttcgataatgtcggagatcgtattggaccataggcatacggccctgatgctggtcgtggtgttcgtcgccacgttcatggacggactggacgggagtatcgtcagcgtagcccttcccgagataggcgaagacctcggagtggacacggctacaagctcctgggtcaccatcatatacatgatgatcctggccgggaccctggtcatgttcgccaggatctcggccgacaccggggtcagaaaggtcatggccataggtcttgcggtattcacggccggttcgctcttctgcggattctccacatcgttctggatgctcatcgcgttcaggatcatccaggcggtgggagcggccatgatggccgcggcaggtccgatgtgctgcacggagcatctgccgcctgagaaactggcgttcggcctctccgtggtcaccatagggtcctccctgggattcgccgtaggtcccgccctggggggactcatcgtggaatacaccacctggcactggatcttccttatcaacatccccatagggctggcggccgcacccctgatgctcaaggcggtcccgccgtccagcgagaaaggggggaggatccgtctcgacaagacgggggtcgtcctcctgttctcggccatagccctcggcacgttcgcggtggagaccctctcctactccgacatgagggtgtggtccgcatccaccggtgtcatgtgcttgatccttctggcggcattcgtcaaatgggaaagaaagcaggaggaaccccttctgcagctgcgcatgttcgcacgccgggatttctcggccatattcctctgtctgatgatgataaacctgtcctacatggggatgctctatctgatcccgttcttcggcaagatatgcgccggcatgagcaccctcgaggtcggcatgttccttctggaggcggccgccctgaccgccgtgttcgggatgcccatagccagatggtccgacaggaagggcaggaggatgttctgcgtggcggccggactgttcacggcactggcgttcttcatgttcgccgtattcgccgacggcatgacgcacctgatcttctttgcgataatgatcccccagggcctcggatgggcgttcaccggcggccccatggcatcgcggctcgtggaacatgcgggggaggacagggacatggcgtcctctctgaccaacgaggcgtacttcataggaggggccatgggtaccgccctggcggccatggtgttcacgacgttctcccattccgacgggatcgatatcgccgccgtgtccagcacggcgttcttggacgggttcgtaccgaccgccgtgatgtgtgccttgctggccgtggtcctggcgataatatcgtacgtcgtaagggacggggaagaaaagtaaaggggttttaataggaaggaaaggtcactggagcttcgcctgcgccttcgccatgaacttctcggagtgcacgacgaacctctcgtggacaccggtgcctacgtccccgaaggcgtccgtcacggaaacggagaaccttatcctcgccctgtccacctcgacgacctccaccctgcatctgacctcggacccgacgggggaggcggaaacatgcttgacatccaccaaggtccccacggtggtgtctccctcgggaagctctgtggcgacggcctccatggcggtctcctcgacgagcaggatcatcttaggggtggcaagcaccgggagggtgccgctcccccatgccttcgcggtgtcctcctccttcacggagaggactttctcggcggacattccgacggttatcatcgtttccccatcgcacacaccggatttaaaactcgcagtagctacgcccggtgcctgaatgtgtatgagccagacgtccgacccgacatcctgccggacggaggacgggaccgtaccgtcccaccaccttttttaacctataattataatgtcctcagcaaaggatgggaaccttatgagcctggaggacagcctctacaacgaactatacgatctcagggacagactgcggaacgagcgtgtgtattccaacggccgcatgccttctgtctgttccgacgaagcgctgagggagatggcgcaacgcattccgaccaaactcgacgatttcaccgcgatagaggggatcggacagaaattcgtcgaacagtacggggaggagttcctcgcggtcacgaggaagtacgccttcacggcggccaagggatcgaagatagaaagaggtctcgcccagacgctcagggaactgcagaagaaactggtcaacatcagcaaaggcaaccgcctcctctaccagcccaagaccagctccaagaactcctacgacctccttaacaccgtacagggcaaggacgtcatcgacctgatattcggatccaagcgggtgctccacgtatgcgaatcgtcgcgcgggaaggagaacgagaaggcctaccgcagactcgggaacatcctgagggaggtcaacagggaccagagggaaaggggtgcgttcgacctctacatcgcatacccgttcgtcgagggaagactcgtcggggaggacgacttctacgtccgcgccccgctggtcctcttccccgtcatcatggagaaggacggttccgtcttcaaagtgaagatggacgattccagggacccgatctacaacaacaccctggtcctggcggccatgaaggtcgcgaagaagaaccgcgccatgccggacaacgtcattgacgcctacgacgagaagacgttcctgtccgacctcctgacctactacgaggatgcgggattcaccatggacgtccctaagggaagggtgcagttgtcagcattcagggagtacaaggccgacgagttcccccgctaccttccgggggagatgcatctgacctacaatgcggtcctggggaagtacccgtcctactccaacttcatccagagggacttcgatacgcttctgggcggaaaggagataaaccacaccctgtccgacctcataaaagacctcaacaaggaggatttctattcggaataccccctgccgctgagcctcgacgagctcaaggagaaggggatggaggcctccgagagggacctcgtgtatatcaaccacctcaacagcgcacaggagaacgtccttaccgccatatccaaggaggacgagatcgtcgtccagggacctccgggaacggggaaatcccaggtcataaccggcctcatctccgcggccgtcgtatcggggaagaccgtcctgatggtgtccgagaagaagaccgcgctcgacgtggtctattcccgtatggggaccttgtcgaaatactgcatgcagatcgacgacaccgcagacaaggacaggttctaccagcagctgggcgtcatgctcaacatcccccctctggccatgggcacggacctgtcccccgtggcggaccagatagactgcgacgtgggtaagctcaccgggatcgcaagggagatctacgagcccgactccttcgggatcgcccccgtcaaactctacgccatggataaatggctggattccaacgacagagggcagttcgagacctacaggagatatcagaagaccgtgtccccctccctcctgtccatcaagtacggggcggtgaaggacctccacgggaagttctccgaccccgtcctcgtgaacaactaccaggagtacatggacatcaccgagaggtcgccgtggatgaccataatgaagcaggacctcaacaacttccagatcgcggagctcaggaccgatctcgaacgcctcgacggagaggtgtccgacctgagcaagaagggattcctctcgaggctcttctccaaggggaaggtcacccgcgacgccaccgccatcgtcaacaaatacttccagaactacaacagcaagaccatcgagaacgtcatgggcgacccgatagccgtggcggacgccatggacgactacgacatgtatacgaacagggccaccgtctaccacaacctcaccatagacgaaagggagtatgggaaggacctgcttctgctgagcagggacctcaacgccccctacgacctcgtcaacgacgagatgctccgctatatcctcaacgaccaccttcagaggttcgacgccacacacaagatgatcatgcaggagctccacgacttcgacagcataatcgcggacatggatgcgaagatggcccagaagagggagatgacgagacagctcctcgagagcaccctcagcaacgacctccgctatatcacggagtctaagagacgcggggacatcgtgaggatagtcgacaacaagaggaagtggagtctcaacaaattcatagaccgctacgggtacgagctgttcaaaggcatccgcgtgtggcttctgacccccgaggtggtctccgagatcatacccatggagatggggctcttcgaccttctgatattcgacgaggcgtcccagatgtacgtcgaaagagggataccctccatatacagggcgaagaaggtcgtggtcgcaggggaccacaagcagctgagaccgtccagcctgggtaccggaagggtcacgtacgacgaggacgacgacgagatggaggattccgacatcgacatcaatgcggccctggaggaggagagccttctggacctcgcaaggtcccgctacgacagcatcctcctgaacttccattacaggtcgaagtacgaggaactcatcgcattctccaactatgccttctacggaggcagactgttcgtatcccccaacgtggccaaacccgagaggcctccgatagaggtcatcagggtcgacgggacttgggaggacagatgcaacaccgccgaggccgacaggatcgtcggactcctgaagatgttcttctccgaaaggaagaaccgcgagacggtcggcatcatcacgttcaacgtatcccagagggatctgataagcgaccgcatagacgaggaatgtgccagagaccccgtgttcgccgcggctgtgaacgccgagagcagaaggttcgacaacgaggaggacgtaggactgttcgtgaagaacatcgagtccgtccaaggagacgagagggatgtcatcatgttctccgtcggctatgccaagaaccgggaggggaagttcatgcagaggttcggatggctgaacgcccgcggcggggagaacaggctgaacgtcgccatatccagggcgaagaagaagatattcatagtcaattccttcgaacccgaggaactgcaggtggacaacctcaaatcggaaggtccaaagatcctgaagaagtatctgcaatatgccagagcagtgagcgacgggaacggggaggtggcccaatccatcctccagtcgttcgtgggtcccgacgggaagaggtatgcggaggagatccagcggatccccgtcatggacaaggtgtacgaggccctcctgagaaagggatacaccgtctcccgcaacgtcggcatcggaggatacaccatagacctggccgtcaaacaggacgacagatacatactcggcatagaatgcgacagcaggatatacgatatgagcggaaacaccagggagagggactaccatcgccagaaatatctggaatccagaggctggcacatacatcgcgtatggacccccggcatgtggaaggaccccgactccgagatctccaagatagtgactgccatcgagaaggcacagtcttcctgatgaatccaaccaaattaggaatgccaaaaccttttatccttttcttcccatgaacgcatatggcaaagaaacttaccctgaagatcgacaacatgatgtgcgagaagtgtgtcgaaagggtcgaaaacgccctcggatcggtggaaggcgtcaccgatctggaggtctccaagggaaaggccgtcatgagatacgacgagtccaagaccgacgaagagaggatcctcgcggcggtcatcgacgccggctatcctgcgaaggtcaagaagggtctgttctgagatgatcaaggagaccctccgcataggcggcatgtcgtgtgcggcatgcgccgtcaaaatagaggaatccgtcagaaaggtggacggggtcgaggaggcgacggccaactacggcaacaacacgatgaccgtcgaatattcggaggggaccgaccgcgccctgatagtgagggccgtggagaaggccggctacacggtcatcgaaggcgacgccgaagccatagccgaagcggacaggaaagaagcatcatacaagaaaagaaacctcatcctggcacttgcattctccatacctctgagcatctatgccatgggccctatggtcggactcgacgtaccgttccatgacgaccccgggatctattccgcgatacagctggtactatgtgcggtcgtcatgttcgcagggaggaggttcttcacccgcggcatatccggtctcctgaggatgagcccgaatatggattcgctcatctgtctgggatcgggggtaggattcctttacgggacatattgcacattgtcggtattcggcggcgatacggggatggccgaccaccttacattcgattcggcggccatgatcatcgccttcgtatcggtgggaaaatatctggaggccatgggcaaagtcaggacgaacgatgccgtatccggactcatggacatgaggcccagcgaggcttccgtgatccgcggaggaaaagaggtccgcataccggccgacgaactggtcgaaggagacgtcgtcctcgtgaggccgggggaaggcataccggccgacgggaccgtgatggaaggatgttccagcgtggacgagtccatgctcacgggggagagtgcccccgtatccaagagaccgggggacggcgtatacggggccacagtcaacggggaaagcagcctccgcatcagggcggaccatgtggggaaggatacggtactgtatcagatcgtggggatgatcgagggggcgcaagggaccaaggcccccatcgcgaggatcgcggacagggctgcggcggtattcgttccggcagtcatctgcatagccgtcgcatcctgtctactctggctcatagcaggcggcagaagcgtatccttctccttgaccgtcctcatatccgtccttgtgatatcgtgcccgtgcgcactcggactcgcgacacctttggccataatcatggggaccgggaaagcggccaagcacgggatactgttcaaaagtgcggccacattggaggccgccggcagggtggacgccgtcatattggacaagaccgggacgataaccgagggctgtccggaagtgacctccatatatgtgccagatggaagcgatgacataatactcccgtatgcggcggcggccgaacaggattccgaacaccccatagccaaggccatcaggcacagggccgaggccgacggcatacatatcccggaccacaccgccttcgaatcgaggacgggtaacggggtcatatgcgacgtggaagggacgaagaccgtggtcggcaacggcgcactcatggccgagatgggtatcgacgtatcggagctggaagccagatactcatccctgtccgcagaggcgaagacctgcgtatatgtggcgttggacgggaaggcccgtgggataatctcggtatctgaccctgtaaaaaagacatccggatccgcagtcgcatccatgatatccttgggagtcgcacctataatggtcacaggcgacaacggggataccgcattggccgtgggcagaacggtcgggatagacgatatccgctacggtgcgatgccgaaggacaagatcgatatagtcaaggaactccagataaaacagaagaccgtggccatggtgggggacggaataaacgatgcccctgccctgacccaggccaatgtgggcatggccgtcggctccggaaccgacatagccataggtgcggccgacgtggtcctgatgaacacggacctccgcacggtaccgacagtcctggagataggcagggccacggtgaggaacatacgccagaacctcttcctggcattcgtatacaacgccatctgtatcccgatagcggcaggcctcccctacattctggggatgggggaattcacccacatgccgatgctcgccgcagcggccatggcctgctcttcgctttccgtaacggccaacgccctgcgcctgggaagattcgaacccggatccataacgcatgagtaaagacggatccagaccccgtgtcactgcatgccatattctggatgttccaggcagcatacatgtatccccgaccgggcatccgcggccccatcaccatgttgagggaccgcatcactgggtatcggggaccagctccctgacatggagcgtcccgttgtttctggaccattccctttcggaggagacgatcctgagtcttttggaatataagggggaataaagcgccatcgactcgtactcccctccctcgcccatgatgctgatatgatacttcgccctcagacgtttgaggtccttcacggtctcggcatctatcggccttcctaaccacgactcgtcgaaaccctcggcatagcacccgactatcacggcctcgatcccggcatcgagcatctggtccataagcatgtcctggtccttcctccacagaggggctatgagcttaagacccagatcgccgcagaccatgttcatcctgtcccactggtagtcggaccatatggcacctgtgactataccctcgacatccagaccttcgagggccctgcgcatgccctccatatcgctgccctcctccccggtactatgacccagaaccaattttttacccatggactcggccatcgccggcaccgtgttgaggttcggggtgtggaagatccacgaagccctgtcctccgggactatgttgaccagataagggacatcgtgaccctgttgctccgccagatacagggagaatgcggaatccttccctccggaatacagcgacgccaagcgcatacggtgtccaacctgcgctatccttaaatgatttttcgtcgatgggcgccgaagaggaaagcgaccatgacagaatgcgaccccaaggcgatgaagaaggctgcggccgagaaagcggttgacgagtatgtgaaagacggcatgaccgtaggtctcggtaccggaagcaccgcatacttcgccatcatgagggtcgcagaactcgtcaaacagggttacagattgaaatgcgtcgccacgtcccagcagaccgaggacatcgccgtggagaacggcatcgaggtcgtggacataaacgatgttgactacatcgacgtcacgatcgacggggccgacgaggtcgatccaaaactgaacctcatcaaaggactcggaggagccctcctgagggagaagatcgtcgccgccgcgacccagatggaggtcatcgtcgtggacgagtccaagatcgtcgagagtctgggtgtcaagacctcacttcctgtagaggtgtgcagatttggtcacgtcaggaccgcatacggactcaaactccagggatgcgagcccgtacttaggatgaagggcggcgagcctttcgtctccgacggaggcaactacatctacgactgcaaattcccgcagatcgacaagccgttcttccttcaatccgccatagatacgatccccggggtcgtcgaatgcggactgttcctcaatatggccgccgcggccgtcgttgctcacaaagacggtaccgtgacagagatgaaatgctgaaaaacgtcccttcgggggcgttctttcattatatcgttaaatataacctcggtattgctagcctcaattacttgacaataggcgggtattaaatagaaccagcatattgggaaagtttgcatttcataggtgataataatgaaaatgcccagaactatcaaaacctattgcccctactgcggcactcacaccgagcacgcagtcgagagggtaaagaagaagaaggccagcgagctcaaatggggacagaggagattcagagaggtcacctccggatacggaggattccctaggcctaagcccgagggaagggaaaagccgaccaagagggtcaacctcagatacaggtgcgagacctgcaagaaggcacatctgtccgcatgcatcagggcgaagaagttcgaactcacagagtgatccagatgaccaacaactttgttaaggtaaagtgccccgactgcggcgcagagcagattgtattcaagaaagctgctactaaagtactttgcaacgtctgcggatccgttctcgtcacccccaagggtggaaacggagagatcagcggcgaagtgcttgaggtggttggctgatgtccaggaccaggggctttcccgagaacggagaactcgtagtctgcaccgtcacctctgtaaagaacttcggtgcattcgtcacactagacgagtacgacaacaaagagggcttcattcacgtaagggatatagccactggttgggtcaaatacatcagagactacataagagaaggacagaaaactgtctgcaaagttctgggcgtggactcacagaaaggtcacatcgacctttctctgaagtccgtcaacgaccaccagaagagagaaagaatccagcagtggaagaacgagaagaaggccgagaaacttctcgaaatcgtttccacgagactgtcgatcagcgtcgatgacgcctacgacgacttcggaaaccagctgcttgaggactacggaaccctctacgacgccttcgagggcgtggtcgctgaacccgaggaattcaccagctactattccggcaactggatcgacgcattcgtagaggtcgcgaaagagaacatcgcacctccgaccgtccagatcgaggctaccctcgagatgtcttcctccgcacccaacggagtgatacttatcaggaacgcactcgaggccggactcgaagcggcagaaggcgccgatgcgaagatcaccagcgtcggatcacccagatacagggtcgtcgtcaccgcctccgaatacaagacggcggaagacatcctcaagagggtcgctaaggccgccatcgacaacctcaccgcagagggcggggtcgccgtcctcaaacgcgagagcaagtgagatgaggtcacagatccgcagatgcccgcaatgcgggcgctatacactttccgaagtctgcggcagatgcacctctcccaccgtatgtccgatacctcccagattttcaccggaggatcgttacggcaaatacagacgcgaaaccctgaaacaggagtatggcgagaatggaaagtatcgtaaagtatgattccaaacccgtccttaaggatccaatccttatagaggcacttcccgggatcggcaacgtgggaaagatagcaggggatttcatcgctgactccctgggagcggtcaagtttgccagcatcttctcaatgaacttccctccgcaggtcaatcccgaccaggactgcgtcgtccacatggcatgtaacgaactctggtatgccaagacccctaacggccaggacatagtgttcctcagaggaaactatcagggaagcacgccggaaggacaattcatactggcacaggacgtcatggagatcatgatgtcgtatgacgtatcgaaggtcataaccctcggcggatacggcacaggacagatgatcgacgaaccgcacgtctatggagcactgtccagaaaagagctcagagacggattggaggaactcggcgtcacgttcaatcccggcgaaccccaggccgggataataggtgccgcgggtctcctgataggaatgtcccagatcaatgggatcgacggtttctgcctcatgggcgagacctccggtttcttcgaagaccacaagagtgcgatggccgtcgtaaaggtcttgactaagattttcggcatggaggacgtcgacttgaaggaactccaggacaagtctcagaagatcgacgagcttaccgagcaggtcaaagccgccaataatgagaaaccgaagctcaacgaactcggttacatcggctgaaccgggattaactttttatatcgtttcactatcccttgaatcagtccccacctagctcagactggctagagcggctgactgtagagtgttctcggagagatccgatacagccgctgatatcagcaggtcccctgttcaaatcagggggtggggaccacttgtgattcatcggatcggaatacgccatggagatactcaccatcatccttctcgctatcggattggcaatggatgccttcgcagtatccatctgcaagggactggccatgggcaaggcccaatggaggagcatgatcgtcatagggctctggttcggagccttccaggcgataatgccgataatcgggtattttcttggacgttcctgctatgatctgataaaagactacgaccactggatcgccgccgccctcctgttcctgataggtgtgaatatgatccgcgaggccctgtccggtgaagaggaggatgtgaacgccgacatagggttcaaggtcatgcttatactggctattgcgaccagcatagacgcccttgccatcggcatatccatcgccatggacagcgacggaagcatcttcgcctccgcactggtgatcggcgtgataacgatggtcatatcgatggtcggcgtcaagatagggagtgtcttcggagacaggttcggtacgaaggccgagatactgggaggggtcatcctcatcctgatcggcgtaaaggtcatcctggagcataccgggtacctgtaagccgggatcacctgcgcatcttggacaggtttctgataagtttggagaaacgaagtttcgtcataccgcttatcccgtcatacagatccgagatgctttgagagaaacatgcgagcctgtcgaaggatccgctgtctataccgaacctttcgcgctcgtccggggtgaaaaggtcccctacggacctcatgacgttgtcctcggtgatctcggtgaagttcacgacggtgataccccctatccccttggaatagacgaagaatttgtcaccctgctcatcggtgttcaccaggacgatggccttgcgctcgatcctcctgagttccataaggatgtcgctcatctcggcattcgttccgcccagaccgtttatgggcaggaagtccacgttggtcgggaatccgcggacgttcagctccgacgagaatgcgttgaggacgaagtactcggtgaatccgctgacaaacacggtcatcctgtcctcggaacgcatatagttacggttgacggtgagaccctccaatatcggtttcaaaatatcgtggtcgtccttctcggtacggtcgaaacggttgtttatgaccgccccgccgttgttccggggactcactatcctgacctcgtcgagatgacgtatgtcgacggccatgggattctgcgtggcgatgacgaacgtcacgcccatcttcttcccgaacttgcgtatggtctcggtaagctcccccacggtactgtagttgagcatgttgccgaactcgtcgatgaggatgatgtcccccgggaaaaggaccctcttgccgaagaggacgatgaaaaagtcgaacagccatctgaacccttccgactggtggtcgatgtcgagcaggatgtctccgcgcctgagttccaccgaaacggagctgctgtcgaggatgactctgaagtcatacctgccattcccgttcatcaactcgctgaaattgttggcgatgtccgccaacatgatgttgatgttgttctccagctcctttctggacttcctgccttccttgtaggcatccgccagcatctctttggtacatccggtggaacgcaggatgcttatgatgaagtcggtgagattataggggtcgcagacgaggtcgtcgcgtttggccttatgagggatatgccggaagacgcgctggcttatggcgtatccgtaacggttctcgaaacctttcgtcaacgaagtggattcattgccgaatatgcccgacatggtctcctcgggatatctctccatgaacgacagcaggttactccaagaccgaccgtatctgcttccaagctccggctgttccgcaaggaccctgtaacacatgtccgtgtagaatatctggtcgtgacgcgctccggtgtcacggaccgcattgtacatgttggggtcgaatatcgcgaggaaggacatgccgtcaacgatgtactgccgatactgctcgtaggacagggtgctggagctcacccttatgtcgttgccgtcggaatccttcaggggatccactatgcttgagacgtacatccccgagtggtccgacggatcggtcctctccatgatggagagggcttctaggaatatctcgtaactcttctcgctgcaaagggccttgaggacatcgtcgagggtcagaggaggagccatacatgcataacgccctccggctatggtcatgttcagaacaggttccctgacatcgctgacgaagtctgtatagtcatccggaccgatctgatccttgtaccaggcctccaatgcggcaagtacactggatttaccgcagttgttggccccgataagcgtcaccagaccacctatgctgttcctgtcgagacctctgtttatgatcagacgggtacggtgctgccttccatctataagaggacccagattcctgaagttcgatatggtaagagcgcgggtctcatcatagcgttcttcttcaggttccataaacatacctcggcgggatagggcccgtagacccctcagttgcagttgttctgaccgtcgacgtagaaggtcatgattatgttcttcccatcctcggtgaggtcgtacttcgccttggaggagggtttgtctatccatttgtgcttctgccaggcctgtatgtagtggcgctggtagtacatgatctccttctgtttggaatccgtcttcttctcgtggatgttgggttcgtattcccataggccggcgttcttcaaggcggagattatggacaccgccgtcacggaatgcttggcctcgcggatctgcgaatacagcctcagactcctgacgagattctcgtcgggtttgtcgatgtcgaatgcgggtatcggacggggatcgaagatctccgaggtcagtcccaccggcctgccgttctcgtagtagagctcgcgaagcctgtccttgggcacggtatatgctttcgtacctacggtgaatgcggtagtacccgtcatcagggcactgacgatggcggcggcactgaactccgacggtccggcggacgagtttataagtatctcggggtcaccgtatgccgtcttgacctcctctatactcgtcagaaggcacctcagcatcttctggaagttgtatatggggtcggatgcgtgctccacgatacggatggtcggcatggatgccctgagccgggataccacctcgtcatagaactcgctgtagacgttgtcgctctgcgaagggtcgcggacgtagtggaacagatggatctcgtccacattataacggactgcaggttccaccaccatgacggtctcgaacgatacgcaagcatacattatgcggatgctgttctggacgggtttgctccacattggactcactaataagttcatgtaaacttgctggcgttatatatctttgtactcgttgtatttctcgttcctgccgcggaccctgtccgcgggatacttcctcgcattctcctccatcttggaacagagggcctccgacaggtctatgtcgttcatctgtgcgaatctgaggacgaaatagaggacgtcggagagttcgtcgcggatgtctttccccctcacagggtctgctatggcacccttgcattgggcggcatccttgaaacggaagatctccaggagttcggcggactccgtgaccattccgatggccagttccttcgggtcgtggaactggtcccactcgcgttcctcgcagaaggcacggaccttcgatttaaggtcggagaccgtcgtatcgtcgtctgtcataccggataatccgaaggtacggataatatgatttcctcgttccggaaacagatgtgcacgacagggtttttatcgtcatgaagaagatatgcaatacgtatgaaacgggatatcgtaaagatcgacggcgagaggtgtacggggtgcggagagtgtgtgaaggcatgctccgaaggggcaataaagatggtcggcgggaaggcggtccttgcggatgaggcctgctgcgacggactgggagcgtgtcttcctgcctgcccggcaggggccatatccatagaggagagggatgtcgggacggtcccggcacatacggtcccggaagggatggttcccatgacgtcatgtcccggctccggcccccggcgcatagtgcgggacggggggcagcccgaaggcagtctgtcccactggcccgtgcaactcagactcgtcccggagaacgccccctatctgaagggctgcgacctgctggtggccgccgactgttccgcgttcgcatgcggtgacttccacaggaaattcatagaggggcacgtgaccgtgatagggtgtcccaaactcgatccccgggagagctgggagaaactgtcacgcatcgtcgcggccaacgacatcaggagcataacggcggtacgtatggatgtcccgtgctgctcggggatagcgaatgcggcgctgtccgccgcccgtttatgcggaaaggacatcgaagtgaagatatccaccgtgcgtccggacggaaaggtgatggaatgaagggagagacgatattcgacaggatgagaaaggggatgccgatcggaagactcgatccagagatcgacaggttcgacgaggcgatagcggagggtgacgaactccgtatggagtataacacatcgcacctgaaccgtgaccagaggaagggactcctggagaagatcctccatgccaaggtcaagggggctacgaaggtcataccgccgttccatttcgatttcggattcaacatccatctcggggagaacgacatagtgaattacgacgtcgtgatgctggatgacgccgagatattcatcggggacaacgtcctcataggtcccggggcgaaatttgtgactgcatcccatccgaaggacatcgaaatgcgtgagatgaatccgttcatgacctatgcggagcccataaagatcggcaacaacgtgtggatcggggcgggggcgataatccttcccgggatcaccgtcggagatgatgcgatagtgggtgcgggagccgtggtgactcacgatgtggaacccaggaccatcgtggtaggcaatcccgccaagatcctgcgccgtttgtaaccgttgcatagacactgtggggccgtaaggccccgaaaaaccccattcgtcatagaggatatcctgctggatagggactccacaatacatccaactcggagaacccggtttttcagtgaacgggatgttcttgtcattttggcaccatgtatataaaatcccgatgtgacggaaacaaaccggctgtcaagatatcatacacatattgcttacataaggggtttccgtccaaaaaatatacattttcatcggtatcgaatgtgccagcattcccaaaattatccttacagtgtcaaaaataaaaaaatatttcccatccataaaacagtataaaatgtaaaaacaacttatattgttcatgtccgacctgacaaagcaagcattgattgcatctttcaagaaattgttagagaccgaaccgttcgacaagataacgatctccgatatcacaaacgattgcggcctctcgagacagacgttctactaccacttccgggacatcttcgacatgataagatggatctacaactcagagtcgctgaacgagatcggcggcagaggaggatacgggacgtggcaggacaagatcagagagctgttcgattataccttgaacaacaaatccctgatcctgggaacgttcaattccaagtgcaggaacgacctagtcggatactacatggatgtcagcatcaggaagatctccgacatcgtggagatgaagtccgacggagacatcgccgagaaggataagaagttcatagccagcgtctacgcctatgcgttcgtcggcataatggtggactggatatccgacgggatgaaggagtcctcggaagagatggtggaccgcgtctacaagatcgtcatgtccaacttcgacaggacccttgccgcattccgtcagacgcgcctgtactgaaacagcagaattaaaccaaccacatgcgggtcccgcatcggactggagacccgcataccttttaatcaaaaagacatgcctgtgggttaatggactacgccctcaaagaccacacttgggatttcctgtacctgatattcatggtgatcgacctgtacatagtggtcaatctccttgtaaggaaacgttcggacttccgcaagcagctgggctggctcatcgtcatgatgttcaatcccatcgtagggttcggagcgtacataatggtcggaaagcccatgttcatcagaagcttcgcccgccacaagaacgagggtatggagatcatcgaccggaagatctcggagagcccggtctgcaggaagagcctgtccgtggcccgcgccctgagcgcatccggtgccctggcatattcggaggacagttccgtctcgtacatagggaggggctcccagtatttcgacgagctctacacggacctccggaaggcacagacgtccatatgcatcgaatgctacatcatacgccgcgacgagaccttcagggagttcatggacatcctgagcgagagggcgagggccggtgtagacgtgcgtgtcatattcgacgactacggatacgacggcaaggatatgcgctacataaaggggatgaaggacgccgggtgcaggtgcgtgttcttccacaatatgaacagactcctgttcagccccctgaagaactgcaggaaccacaggaagaccgtggtcatagacggccgcatagcgtatcagggcggattcaacatcggcgacgaatacatgggcgagggccccctgggggaatggagggacgccgccgtcaggatcgtcggaccccaggcccaacagctgggaaggatgttcgcagaggactgggagtacaccaccaaggaggacatatccggccttcccgccctgttcccgcatgtggaacctgcgggcgacacccctatgcaggtggtgcccggggacccggtggtccaggacctcaaccccctcatgtgccagttcctcgccatgatagagtgctccggggactcgctgtacatagagaccccgtacttcgtaccgccgagacctatattcgaggcattggccatgagggccaggtccggaacggacgtgaggataatcatccccgacgaggccgaccacccctgcgtatactggagcaaccgccattatgccagcatcatgatggaggcgggggccaaggtctacgaataccacggaggcttcatccacacgaagatgataatcggagacggccagtactgctccgtcggatcggccaatttcgacgagaggagcatacacataaacctcgaatgcaatgtcctaatgtattccgagaagatgggcgaaaagcttacggaggagttcatgagagatctggggaacagtaccgaatacaccatggagatgtacgactccaggacccggtcccagcgcttcaagacgttcctgtccctcatcacctacgaccagctgtaaagacccagaatgtagaaagaggcgatctggaaatggacatcctccctataatcatagtcctcaacgcaatattcatccttgccgcgatgtacgccgagcgcgccaacccgcagatgctggtcttatggatggtgctcatgggcaccctcccccttataggattcatcctgtacctgatgttcggacagacgttctattcccgctatgcgttcaaaaggaagagggatgacgatgcgaaatccatgatcgacccggacaaggtcaggaaattcggcctggatcctcgcagcgacggcatgtcccaggcattggagagatcaggggcgtcgcaatgtctcggaggaaacgacgtccgctatgtgagcgagagcgaggacttcttcgacagtctcttcgaagcgatggagaaggccgagcaccacctgttcctggagtactacatactcaggaaggatgcgaccgggagaaggatcctggagatccttatagagaaggcgaaggcgggcgtcatggtgaggctcctggtggacgaggtcggaactcgcaacctgcccaaggacctgaagaaggaactcaaaaaggccggcgggaaggtctacacgttccataagatctcgaccctcctcctgagtgccaagaagaacaacaggaaccacaggaagatcgcggtcatcgacggtaagaaggccttcgtcagcggatacaacatcggcgacgaatacctgggaaaggggaaattcggccactggcgtgacgccgccgtgatcatagaaggacccatagtcgactgctacacccgcgtgttccttcaggactggagatatgccagcttcgaagatctggtcaacgaccgcgacctctattgcgccgaggagtcggggaaggacatccccgtccaagagacccacgggggcccggatatgccggggaccaactccatacacatgcagtatgtcagcatcgccaccgcatcccgtgaacagatatggctgaccaccccctatctgggaccttcggatgccgtcctctaccagctccgcctcaaggcgctggccggtgcggacgtccgcgtcatcatccccgacataggcgaccatgtcttcgtctactggggcaacagatactgtgccagcagactcatggatgcaggcgtcaaggtatacgagtaccatgacggattcatccacgccaagaccatggtcggggacggatactactgcgccgtaggttcggccaacctcgatccgagaagtatgaacctcaacttcgaatgcaatgcgatggtatattccgaagaagtcggaaaacagatgacccaggcgttcgaaaaggacctcgagagatgtaccgagtacaccatggagatgtatcggaacaggaccggcatacagaggatcaagacgttcctgtcgagattcgccgcggagcttctctgagcaacgtattaatcagcataaggatatttgatacccatgaccagcagggcagacatcgagaagatcaagaagaagagatacgaggcactggcacccatactcatagagaatctggaaagcagacagtatgaggcgtattacgtcgataacggcgaagaggccgtgaagaaggccctgtccctcatgccggccaaatcctcggtttcatggggagggtccgcaaccatcgaggagataggcctgttggacaaggtgaaatccggaccgtacaaggtactcgaccgctccgaggcctccacccccgaggaaaaggaggacatgctgagacgcgcactttccgtagacttctatctgaccagtttcaacggcgtgagcatggatggcatagtcttcaacatcgacggcaccggaaaccgcgtcgccgccatcacgttcggaccgaggaacgtcatagcggtcgtcggcatgaacaaggtatgcaaggatcaggaacaggcactggcaagggcggaggacatcgccgcacagatgaatgcggcccgtttcggcatggaagacaccctcttcaccgacggagatgtgaccgacgactgcaaagcaccgaagtccatatgcaacttcatcgaacagatagtgttctgcgggaaaccgaagaggatcaaggtcatcctcgtcggcgaggaccttggtttctgatcctgtccttgatcttggaaccgatcttcgatccggaacgccggatggagcgcacccccgacctggtctgtacatagaaggccgagggggcgtgctccatgaaacggacgaaggattccgaccccatcttggccttcttgatcaccgatttctcctgtccgatgaccaggctgtaaccgccctttatcccgtccaggaactcctcgcggttcgatgcctgtaccgcggttatgacgttgcccacctcttccagcatatggccgtcggtccctccagtatagctaagaccgtactgctctgcggcggccaaggccctcaggttgctggaatgggtcatcccgctgcatatgacctcgtatgcgtcgagcatcttcacgatatcctcgctgagataacccttctctatgcatatctccacccccttgttggtaccgaaataacctagcgggtgtgcggcggaaacgacacagtggatatcctcctgttcgatggtgtagaggagtttctcggtggacatgtccttcaatgccaaccatgggcagctctgcaggttgggacgtatgtatttgcgccagaacgccgacatgtccctggtctcgtagaaatacatgaggatgtgcggaccgtcggaggtgctcacctcgatgccggggatcacgaacacgtccttcttgtcggccaccttgaccgccgatgctatgaggttgtgatcggttatcgcgacacccgtcccgcgcatccgtgctaaagctaccgcgtccatcacgtcggtgaaagaatcggagcagttggtatggaagtgcatgtctgcgaacatgtaccccatctccgatagggaactgtagtcgggaggcccgaagaggaccctgttgctctttatattcaccttaggcatagcgtcttccagatgtcttcggactcgtccgccacggcggccacgtccatggtcgtacataccctgtcgcggaccacgatgtccccctggcacatcacggtcttgacattggcctgggatagggaatatgcgaggttggcgactatgttctcgggaaggagaggtctcaggttggccatcttaccatccaggaccacgacgtccgcatacttccccgcctccagggatccgagggaatcctgcataccgatcgccttggccccgttcacggtgactatgtccagaaggtcctgggcaggcgtgacggtcggatcccatctgctggatttctgaagaagacccagcatcttcatctccgagatcatgtcgagactgttgttggtcgtgttgccgtcggtacccaatgatacgttgacaccatacttctcgaactccgggacgggtgcgacccctcctgtggccagcttcatattggacacgggacaggacgagatggacatccccgcctcccccatcagacggacctcgttcatcgtgagccatgcggaatgtgcggcgaccaccctgggcccgaggacccctatgtgggagagccactcggccggcctcatgccggtcgccttcttgtggtcgttgacctctccgcgggtctccgacagatgcatgtttatgggggcgcccacctcgtcggagaacgccttcgcctccgtacatgtctcctcgttgcacacatagactccctgaaggcccactccgggaacgatcttcctctcgtttttgaacttctgatagaaatgcctacagttgtccacagggttgcccttctgggtcgtcttgtcctcatccaggcagcaccagcagcagacaccccttatccccgcctcctgggtcgccttggcgatgacatcctcggaatagtagaggtccatgaacgtcgtcgttccggacatcatcatctcggcacagccgagcttcgtaccgacctccagatccctgtccgtacggtcggcgtctatcttgaaaaccttgttcaggaaatccgggaacaggaggtcgtccaccactcccttcatgacggacatcgcaacatgcgtgtgggtgtttatgagtccggggatcaaaacgtcccccgcacagtcgatctcctcgtcggcggtaccgttgtacttgggaccgacggagacgatcctctccccgtccaccacgagatcccctttcagaacttccctcttcgcattctgcgtgacgatccacgcatccctgaagaccgttatcataatgttacgaaagcaagggtatcgtaagaaagtttggatgatgcgacccgtggattgtacgtatgaaacgtatgtcaatatgccgtcggtgcgtcatttggaaatagtccgacgtgatagtacggtgcgaccgatatgaccttccgtataacgttcctcggtaccgggggcggcagacatacatcgatgttccaaacgcgctgcaccggcggcatgctcatcgaacacggggaccccgtcatgcgcatgcatgtggacccgggacccggggcactgacccagatgcgcaggatacgctacgatgtgggctccacggactccgtggtgatatcacacgcccacccggaccactattccgacggaccgtgcgttatcgaggggatgacccgcggcggctgggtgaagagaggacacctctacggaagccccaccgtcatagagggggagggaggattgggcccgtgtctctccccataccatctgggtcttcccatatcgagcaccgctttccgtcccggggacgtgctcgatatagacggacagagggtggagatatgccgtgccagacacagcgacccgacgaacgtcgggttccgtttcgacacccccttcggagtggtctcctatgtgagcgacactgactacgacgaggatatcggaaggcagtacatcggcagcagggtgctcatactgccggtgaccaccccccacaacaaccgcatcaactaccacatgtgcacggacaccgcgatagagatggtggacctggtcaagccggaactctgcatattcacccatctgggtatcgtgatgatagaagaaggccctgacgcccaggccgaaatgtgccagaatgccacaggcgtacgcacggtggccggaaaggacctcatggtcctcgacgtgggagaggatctggaactgtcgcaggccaggacctacgacggtgaatggatcccggaatgggcacccaaactcccggaaaaatacagggacggcggacaaaagggaaatttttaaagtaccgattataatggcgggcctatgactatcgaggacgatgtactcgcaagaataagacccaccgaggaggagaggcgccacataaagcacgccgccgacgaactccgcggaaaggtccaggagtacatcgacagggaagggatagatgcggagatccgtttcgtgggatcatactccaaagacacctacctttccgaccccgatatagaccttttcgtcctattccccacctcgatcccccgtgccgaactggagagggtgggactgaagatgggtgacgacatcctccacgggatccgcatgttctcagaacacccgtacacccgcgggagatatgacggggtggatgtcgacctggtacccagctatcacatagaaagcaccgataaactccagacggccgtagacaggacaccgttccataccaggtatgtgctggagaacatgagcgtcgaccagagggaccaggtgaggctcctgaagaagttcatgaaagggatcgggacatacggggcggaacccaacacccgcggattctccggatacctgtgcgaactcctgatcataaaatacggctccttcagaggagttctggaggccgcggcatcggaatggagggaaggtaccgccatcgagatcaaggaaagaggaccccctatgataggtcccctcatcgtatatgacccggtggacaagaagcgcaatgtcgcatcggccgtccacctggatacgctggcactgttcatagccgcggccaaggactacctcgtggaaccgtcggtcaacttcttcttccctaggaaaaggaccccgctgacggtcgaggagctcgaggagaaggcgtccatacacgggtcgaggatactgaccgtcacattcaacagacccgatgccgtagaggacaacctctactcccaactgtggaagacccagtatgccctgataaagaagttggacgatttcgacttcaacgtcctgagggccgtgcacagcatggatgagaaacacatggtcatagccttcgagttggaccgcgacgtcctgtccaagacctgcaagcacgtcggtcccccgatattcgtaagggcggccgaatcattcctcaggaaatggaagaacaacgaatacggggcaccgttcatagaggacggcgcatggtgcgtgatcgtcgagaggatgtatttctccgcagtggaaatgctcgaggaagaggcctccctcgcaggcatagggagggagatcgaccccgaatccatgaagatccgcggccatgaggcatccataacaaacatagaccccttgcttctgacggaattgatggatcccgtactcagctggaaaatcgtctgaaaagcgcctgcatcgattcgatgtatacagaacaagacggataaatccgtggatggagccggaccatttcggaccggcccccggatattgtatggtttatggcttcaaggaaccaggaaaggctggttgatgaagacgatacatattccgagagccataacaaggaagacgaagtagtcacccatcatggtcttggactcgagaaggtccgccctgatgcccagtttcacgtacagcttcttcatggtgaagacggcggcgaacaccatgatggtgtccagaacccaattgatggggtcgccgaggacgttgcagatgacggcggcaaggaaccctacgatcaccgcatagacgatagtgatgaagaggaccttcgttccatagatgtccttgaggataaactccttctcatcgaaattggagggtgtgaactcatattcctcttcgggcttctctttgataagacgcctcttctttgccatagtacttcccgattctatacttcccttataaacttatagggaggggaaatgcgggtattctcgcaatcggttggaattaatataacttttataaagttattcatttcggaatatactgtcctctcggaccctcagatatggtcggggagcagcgatcaagataacgtgcagattgtaatcgattccaaaacaaggttgcaaaacctacccgggtttataaataataacattaacaaattataagttattcatatgtgcctacaatgagccagaatagtcgcatccgtcagattcggtcaccccctagtttcgcttaaatatacaatccgcgtggagaaagatgagagtgaaagaaatggctgagaagacccttgaagacataccgggcgtaggacccgcgatcgcagacaaactccgcgaagcagggtacaccgagataatggccatcgcggtggccgcacccaaggacctcgccgagacctgcgagatcggagagaagaaagcgatggacatcatcgaaggcgcgaaactcgtggcggacatcggcggcttcgagaccggtgacgtgatccagcagaggcgtgcggccgtatccaagctgaccaccggatccaaggcgttcgacgaactcctcggcggcggtctggaaagccaatccataacggagttcttcggggagttcggaagctgcaagacccaggtctgtttccagctggcggtcaacgccacactcccggaggagaagggaggactggactccgacgtgatcatcatcgatacggagaacacgttcaggcccgagaggatcacgcagatgtgcaactacctcggagtggaccccgacgagaccctcaagaggatccacatagccagagcattcaactcccagcaccaggtcctgctcgtagacaaggccctggaactggccaaggacataaaggtcaggctcatgatagtcgactccctgacatcccacttcagatcagaatatctgggaaggggggctctcgcggagagacagcagatcctcaaccgccacatgcacgacctcctgaacttcgccacggtcaacaatgccgtcatcgcagtcaccaaccaggtagcatccaagccggatgcgttcttcggagaccctaccaggcctataggaggacatgtggtgggccacactgccacattccgcatatacctcaggaagggaaaggccggaaagaggatagccagacttatcgactctcccaacatgcccgagggagaggctgtattcatggtgaccgaaaacggtattacggactgacgactggtccatccgtgtatcaatcatacctcttcgaactgctaggcgaactggacgacatgccccgcgacgaggccgtcgccacagtgtataccgagacggacggggactgccgcataatacgcgatggtcccgggtacgtagtaatcagtttcgaagaggaaaaactggatcccatatgctcacgtctggcacttactcacagcgtaggaaggtatctgggatccttcgatccggaagacctgtctcccatagagggggctgggcttccggcaggaacgttcgccctgagacataagcggttcaaggggtggatggccgatgtggactcccagaatctgatccgtaaggtcggtgccgtattttccaagaacaacgatgtggacctcagacatcctgacaccgtggtaaatctccttatgaccgaccaggtacacgcattcatcgaagaaagggtgttcgatgccgacctgttgagggagaggaaagtaagcgagagaccgttcttctctcccatctccctgcatccgaaatatgcacgtgccttgatcaacctgaccggggtcaaaagaggagggaccgtcctcgacccgttttgcggcacaggcggaatcgtgatcgaggcggccaacatgggcatgaaagccatagcctcggatttcgacccggagatggtcgcaggcacccgcgagaacatggattactatggtctggcacttcatgatttcgaagtcattgacatcggagacatacccgagagattccacgatatagacgccatcgcctgcgatcccccgtacggaaggtccactaagacgggtggcgagaagatagaccacatatacgcaagggcgttggaagcgttcccgaaagtactgtcggagaaaggcaaggcgggcgtcgtcatgccccatgttttcgagaatccgtatatggatctgaggaaagtgtacgtccagtatgtacacgggaccctttcacgctattaccacatattcacccgccaataatattataataatatgcgcgataggaaaagaccgtgaacaaatatctccgcctcttcagattcggcaactgtctgatgggggcaatcggcgtactcattgcctgtttcatagccgcaggattcgatctcggcgaccacgccataaaagtgataatcgggtgtgtgctcgtcatatgcttcgaagcgggaggaaacgcactgaatgactatgtcgattacgagatcgatatgacggcccatccggatcgtccgataccgtgcggggagatatcccgtaaaaccgcacagatatgcgggatcgcaggccttgccgtcgcagtcatactttcatttttgatctctttcgataccgtccccttggtcatcctttgcgccatattgatgttcgcatacgagaccgtcctcaaacagaggggattcgtaggaaacctcaccatcgcagtcctgaccggactgatcttcttgttcggcggatccatcatcggagactactcccaggtatagactctggccctccttgcgacactcgtatccatcggaagggagattgcaaaggacatagaggacgtggaatcggacgaagggagcagaaagaccctcccgatgatcatcggaaggaagaaggccgcaaccctcgccgcggcattcttcgtcatcggccccatattgagtttcatccctctgctggacaatactttcggaatattgtattgctccgtcatcgtggcagatataatctttatctattgtgccaccattgtattcaaggacgctcacaaggcggagaagctggcaaaggtcgccatgttcgccgccctcatatcgtttgtactaggtgtgatctgatgaccggtctgaaagaatatctcttcgagagaatgaagaaaggaaccatccatcttactcttctcgatcccgatccggaaaagctctccgaagaaaaagccaaggagattgctgtgaaaatgaaagaggcggggtccgatgcattcatgatcggaggatcgacaggggtcaccagcgagaacctcggtgcggcggccaaagccgtaaggacggcttccggcctccctgcgatatacttcccttccaacccgagagccgtcacctcggaggtggatgggatgttcttcatgagcatcctgaacagcaccgatcccctctacatatcccatggtcatgcgatggtcgcaccatatgtggcgaaactcggcatagagacgataccgatggcctacatcataatcgagcccggcatgacggtggcaagggtcacaaaggcgaaatgcgtcggacatgacgatatagacaccgccgtcggatatgcgcttgcggcagagatgctgggaatgcagctggtctatctggaagcaggaagcggagcggacagaccggtgtcccccgagatgatatccgcagtcaagaaggccatccacgtccccctcatcataggcggaggaataaggactccggaggcggcggaaagggccaggaaagcaggggcagacgcaatagtgaccgggaccttcgtcgagcagtgctccgacgagaacgtcctgagatcggtggtccatgccgccaagggaatctgacatgacacacaaggacgactaccaaccggcctacagccagcccatatccccctctgctccgatgtggcttactcccgaggagagacaggcaggcatcaacaagaaccttaaggtggctgcacacaggttcctctgtcccaactgcgggaaggagttcagccttttccaatcaagggccgtagcctgcaagtactgtcccaaagcggcatcgcgctgtcccaacgtgagatgcccctactgcgactccgagttccccataaacggattcgtcgtacccgatggcaacagacaggaccagagggtgatgaacgactacaccgacgaagtgttcaaccgctgggcagacacttataacagacgctgaaaaaaaaatcctcccggccccataccaacgtggtggccgggatccatcttaagatcttattcctgtatctcgaggcttctgaccccgtagacgggatcatagtccctggacaccttgtcgccgatgatctcttccaagatcacttccatggagagccatactttgacactctcacggaaacaaccggtgacggcctgcccgttgcgacccacggacccatgcatatggattatcggctctccacatatgctgtcacgaatgaccgtgcctaggccgaagaactcgcaattgttctcgagcttatagatgataggttcgtgatgaccgttgttggtatcgcaaagacctacgacaaaacttgatccggcggccacgttgccttccagcgtatagtagccgttcattatgtcatgctctttggcaaagctctcgatagactgctttatcgaatccccgttctcaagctttaagacgaaaatccttccacgcgtcatctcgcggaacttcatccgaatcacctatacttgctatatctatccatgagtctgcagatcctgtcatactcgtcctttgtgagatttccctcgtcgacgaatgtcttggcatagtctttcgcatcgcgcgtagatatgcgcgaggccttcgctatgaccgatgccaggaacgacgatgccatgacggggtccatcgaagactgggacaggatctcgttcatatcgtacttgaaaggagcgatcttgtgggtgttcagcatggactgcctcttagaggcctctttcggcctctgaccctgactccccctcttattctgtctgttcggagacgacggcccgcgactgttggccctctgtgaggatccgcgataggacatgctgtagttggcatcggtcttcttcgggagtttgaggaccttctcctccggaattccatccacgggcacgatcgctatatcgtcatcccctgcattcttatggacaggtgccgaagcgggtcttgcggacgatgtcccctgaggacggggaccggatcccccgctctgtccagcagcagggcgcggccttccgccgtaccctccgctgcttccaccctcacggggcttgtagtccgtcctcggaccggaagcggaatgctggttggaaccttgcgggcgcgaagtcctgtcaccctgcccggtagatccctgagaacggggacccctgtatccggaacctccctctttagggcggtcgccggcgctgcggtgctgaccctcggttgtatttgcacgtgaatccggacgggatgtgtgtccggaagtcggcgcattcgtcctgctcttaggtttgtcatctttaggagcaggcttgcgcggggattctctgttctcttccaaatatatgactccaacgaaatccgatggccacaatatttaaaaatatattgtagaaattgtgcatcgtttgtaccgggcatatgtcttcttttaatttattttaatatttgaaacccatatggagggacagaatggaagagtctgctaaaaagaacaagcgtaagccggtgaacgaacgcgcgggatacatgatacttctcgtcatggcgttattgttcgtggtcatctcattcgtcatgaaagagtatgaaggcatgctggtgtccgtacccacgattatcgtagtggcggtatttctggtacgtaacggcagattctacgtgcctccggccctgatcgtactgatgtccgtcgtcctgttacttttcatgattgcgaaatacagcgtcaagatacagaacgagctgatattcggcggcgtcgcagacttgatgatgggcgctttcctcgggctcatcgggctcatagtcgtctatacgatgctgcgctccatgccgaacttcgacaaggacaatgcgttcttcgtcagtctcagcgctttctgcataggcgtctccctatcggtcataatcctcctgctcaactacaccatcgtctccttccaaaatgaaagcggactcgaatacagcgcccctttcatcgcagtgagggaggtcctgatggtcattgccggaagcggattcgtgaacatcctgttctacctcaaccgccacaacggactgttcaaacacaccctcgaaaagttcctgtcggagaatgctgacacattgggcatagaggaccaggagatacgcaacatcgagaagatcatcgagacgagggagacatccgtcatcgaattcaaatccacgataaggacgaatctgaagacgggggagaaggacccccgcatggagaaggccgtcctcaagaccttggtggcgttcctcaacagcaaggggggcacgctcctgataggggtggcggacgacggcaccgtcatcggagtggacgaggactctttcgaaaaccgtgacaagatgatgctgcatctgaacaatctgataaagacccagataggaggagagttcctcccgtacatcacatacagggctttcgacatggatggcaagaccataataaagatcgactgcagcaggagtgagagccccgtattcctcaaggagggtaaggtggagacattcttcgtccgctccggcccatccagcatagacctccatggaaccgacatgctggcatatgccaaccataacttcggcagccagcttaggaaagtatacaacaagatcaagtgacccacatgaacaaaacggaaacagtcccggagggactccgcggattcttcgaggacaatccccgcctcgccctggcattctccgggggatccgattcgtcatatctgttctatgcggcaaaggcatgcggtgctgacatccgggcatacttcgtaaaaacccagttccagcctcgttccgaaatggaggacgccatcaggaccgcaagatatctggatggggacctgtgcatcatcgacagggacgtcctggccgatggaaggatcgcctccaacccgcccgacagatgctactggtgcaaacacgccgtcttcggcgccatatccgaggccgccaggaaggacgggagggactccgtcatcatcgatgcgacgaacgcatcggacgatccggaaggacgccccgggatgaaggctctgaaggaaatgggtatccgctccccgctgagggagtgccagatatccaaacccgaggtaagggaactttcccgcgaggcaggtctgtggacctggaacctcccatccaactcctgcctggccaccaggacgcccttcgggacggttctgaccgaggacggtctccgcaggacggaggaggccgagcgcagagtggggatgctgggtctttcggatttccgtatcaggacacggggggactccgccttcgtggagacaagggaggaccagatggacatcctggacaggatacggcccgaactggaatcggtcctttcagaatactactccggcatcatcggatacgggataaggaggccgggcctgtgaacacacgggaggtcctggaggccgtaagggacggaaatatgtccaccgaggaggccctcgtaaaactgaagaccgcccccttcgtagagttgggatacgccaaggccgacacccataggaggattagacaagggtccaccgaggtggtctacggtgcggggaagacccccgagcaatccctggggatcgtcaaggccctcgcagaggacggcggatgcgtattggtaacccgctgtccgaaagaaaccgccgatctgctgtccgagaatcttggatgcgtcgaatacgaccgggtgtcggggatatgcaccgtagggcctagaccggtcccgtcacccaacagcctcgtatgcgtagtcacggccgggaccagcgacatccccgtggccgaggaggccgcgaggacggccgaggcgctggggagcagagtggtgcgcatatacgacgcaggagtgtccggcatacaccgcatcctgtccaagaccgataccctggctagggcccgggcagtggtggccgtcgcaggtatggagggggccctcccgagcgtggtgggcggactcgtcgacgtcccggtggtcgccgtccccacctcggtcggctacggggcctctttcggcggcatcaccgcacttttatcaatgatgaactcgtgctcatcgggtgtaagcgttgtcaacatcgacaacggtttcggggcaggatacatagccagcatgatagacagaaggagtgcgccactttgaagacattatatctggaatgcaacgccggggcctccggcgatatgatactgggatctctcactgaccttctgaaggacccgttcgaattcaaacagatgatcgaatgtgcgggcattcctggaataaccgcagaggtaacggtcgacgaccagtcatccgtcgccggcatcagggtgcacatcatggtggacgggatcgaggagggaagcaaggaggaatccggacaccacgaccaccacgccctcaaggacgtcatatcgataatcgggggactgaacgtctcggacatggtcaaaagcgacgccgcacagatctaccgcataatcgccgaggcggagtccaacgtccacggcaagccggtgaacgaggtccatttccacgaggtcggcgcactggatgccatagcggatatcgtcggcgtctgtatgctcatcgagaaactggccccggagcagatcatcgcatcccccctaaggaccgggttcgggaccgtcagttgcgcacacgggatccttccggtccccgcccccgccacggcctacatcctccaagggatgccggtgtacgcaggcgacgaggagggcgagttcaccaccccgaccggtgcggccatcgtcaaacatttcgcagaggcgtacggacagatgccgctgatgaaattcgatgacgtcggatacggtctgggcaggaaatcgttcaagaccgccaacatggtacgcgcctacctgggagacgtggacgaggcactgccgaccgtgaaggagatctcctgcaacatcgacgacatgaccccggaagacataggggggataatcgacctcctgatgtcggccggcgcactggatgcgatgattacctccgccatgatgaagaagagcagacccggctatatcctcacctgcatctgccgggaggaggatgcggacgagctcgccaccgtcatgctcgcccacacttcgtccataggcctgaggatgcacacctgcgaaagatacgagatggggtccagtttcatcacgtaccgcacggacttcggcgacgtacgcatcaaggtctccgaaggatacggcctccgcaagtggaagccggaacacgaggacatggtcaaagcggcgatatcttccggcgtcaccgtggacgaggtccgcaaaagcatccacttcgaccccgacgaggagatcggggacgactgaccgggggcgggaaaacggccggcgtcaccgtggacctgaacgagacggagttcgaccttctggcggattacgccgtgagacacggcgtatccatggccgatgccgcacgttacgccatatccctcatgctcgaggccgagagatgtgccagcatagccgacgatgcgcttagggaagtcctcggcggaaaataagacacctgccggacatggtgcgggggaggggattcgaacccctgaaccgctagggaccggatcttaagtccggcgcctttggccagctcgaccacccccgcctgcgtgaggggaacgccgtttatcgcacataaaggttggtcccgccccgacggacggcgaccctacaaagcgttaatatccagatgccaatcccgtccgcgtgaaattcaagatccccgaccaggataccgtttgcaaggcggtcagcagggtcatgctgcgtaatcaacgcatagagagccagagggagctttccgaccttgtgcagaaggaactgtcctccgaggatccggaataccgcatcagcggcgagcgcataaggaaggtggcggtatcctccggtgcggccaaggtggagatagaatacagggaggcggtcaagaagaagcttcccgacatctgcccggtctgcggcaacgccatgtcccctataatgaacatgaccctggaaggagacgtgacggaggtcaaaaggaactgcaccgtatgcccgttcaccgcaggacagaaggcctgctccccagggagatacatattcgtcagaacgcctccgcacgaagttccggaggaggagatccgcataaggaagctgaggaaggccgcatcgcacctcagggccgccgagaagctgatctccgaggccttggaagggacgaacttccccgacaggggcgccatagccactgacaagatatcggagatactgaggtccaaggatgctgcatggagcatacccaacctggaggccgatatacgggacatcggtcatgaggaccctctgtggaccaatcccctgggatcccccaagtacccgacccgcaaatgaattatagaaacctcttaattacacgcataataaaaggagctgacataccttgaagagctgggagttcaccaaaatcgagggaaataagatcaagatcgacaactggctgtccgacaccatggggctcgtggacgggggatgcatctacagcaccctgttcaagtatcctgataacggacccaagcggtacgagctcatactctcgatgtacccgcaggagaacttccgcacactggcacaggtgactgtctgggccgaggatgtgccggggtccaccgtccagtcggcaaagttcctgaccgaccaggagatcagaatcctcaactccgtctcccttaccgggatctccgacaccacgatcatctggaacattctcgcggacctcaacttcgcaggagagggggaactcatcaaggagaggttcgaacagctcaaggacgcaggggacccctccgtggacaagatcaagtatgtcagcatcaagcccgccaacatcgggaggatcttccgcgagaagaatgacactggctcattgaagaccgaactcaggcacggagcccccgtgacatacgagaacggatgtttcgacctgtccaaggaatacggcgacatcctgaacgatgtcgacggacaggaggtcatgatcaccctcgaccccggatcgtggctcgtatcggtcgtcttcttcaagccggacacggacctcatcaagatcaacatgaatgtgccagactgcatgggttccatcgatacggccctcaagatgctcgcagaggcaggcatcaacctcatctccgtcttcaccaaggtcatgatatcctaccagaccatggacatcgaggtagtcgcggacaggaaggccagcaagatgaccgtggaagagatcggaaagaaactccccgaatacttctccaaactgaacggagtatacgaactcaagggagtagagcgcctctgacatgataggtcgtttcgtcaagaccaccctggcggactggaaaggccgggactgctgccgcatagagttcaggggatacgatgtgaggtatccctacctcggaggttccgacatctatgaccgggaaggaccctgcatagatccggacgagatactgtcatatatacgggaaagaggccagaccctcgacggcatagtcctcggcggaggagaacctctggcgcacgaaggcctgtacggattcctcaaggagctcagaagaaccaaacgccccataatgctggagacccaaggaatgcgtcccgatgttttggacgacctcgccggagccatgatgttcgacatggtccgcctatatgtgccagcatatccgggttctcctaatttcaagaaggccaccggagggtttggcgacccggccctcatgaaaaggtccatggagattgtcaacggcctggatgtcgacagggagttcttcgtctatgccgtccccgggatcgtggacggaccggagatagagaacatagccagatccgtcggggagaagacgtacctgaccatatcccagttcgacccgcgccttgcgacggatccggagtatcggaaaataaggccttacagcaagaccgagggctcggccctctccgcttctgctaaaagatatgcgaagaggaccgctttgaagggtttctgaggatcactccacgaagttgtcgaccgtcgccttgacagcagggacgagggacaggctgcttctgttcacgaacacctgcatgtcaccggcctccgccttgaccctgttgatggtggacgcatccctggacatcactccgaccgcaagtccgcagtcggtctccatgaggtcggcgatcgcatcatccacggtggccaccacccttatgcagagtaccggaagaccctggtcgacgtacaggttgtcatcctccgcatccaatccggtgaatatggcgggagtatagtacaacccgttggaagtgtattccttcctgaccctcttgcctccgaacaggaggaagttctcctcttccttgatgaacttgaggaatctcttctccgtctcatcggacatcagaggtccgcatgcggcggattcctctccgggatcgtctacggaaaagtctttggccctctcgaccaaggccttcgtgaagtccctctcgtcctcggccagtactatgaccttggatgtggagtacagatgctgcccgcagtaggagaatgccgattcgaggacgtcagccgcagctttcttcatgtcggagggattggccacgattataggggtcatccccttcacctcgttgacgaatccgaggccctcgtccaccggaacgaacatcagctcgtccatggccttaccgcatccggacgcgactacaccggagacgttctggtcatccgacagggcggtcacatacctgtccaaacggtcagacacgatgttcatgacacctccgggaagaccggccttctcgaacatgcgatagagggtatacacgggggtcggacagcttccgctgggacttatgacgaccgtgttcccggcggcgatggcaacggccgcatatcccacggcggaggccaacggggaactgttgagggcgatgaccgcccatacgccggtaggccttcctttgaccgtctctgcatcggcggctgccttgtccaagacctcgatgagcctgtcgacctcggcgacggcctccttcctgaccataccggtaccgagaagaagctcggccgccagctgatacctcttcgtacggacgtcctcggccaccttggatatcaccgaggccctttcggcaggagaggtcttggaccaggttgcgaacgcctcgtccgccttctcggccgcgacggcggtggtaccttcctcgggttcctggagggtaccgaagatgatggtgtcgtccaccgggctcacgaggggcatgtccgtaccggaggcgacatacatccccccgataaccgctgggtaatcgtgtttctccttatcgagggccatctgcaaggcggcctcgaacttcgcattatcgaaatcggacggcataatgcagaggttatctgcggttgtactgataagcgtttacatcggatccatcgacggggatctgggacatgacagcaaattttaaaaccgcatcaccgctggaccgccgaggaatatttgcggagtgtgtcgattgtcaaaaacaccgaacttgaattccggggccgcactcgtcgtcgccataggggccgcatcgttcggattcctgggcataccggtccgctttctgggggacaacggattctccgccatggacatcaccatggtgaggcacctggtgaccgccgtcgcactctttgtcataatactcgtggtcgacaggtcgctgctgagggcgagaccgagggacgtgctgttgttcgccctgttcggagcgttcaagctcatgtcggacgtcaccctgttcaagtcccagatgcttatcgacctgtccctttcgacactcctgcagatgaccgcgccttactacgtcatggtcttctccctgttccttttcaaagaacgcataacgatacagaagatgataacggtcatcgtggcgttcatcggatgcatactggtcaccgggatcgtgaccgggaaacatgacgatctgaacttcgtcgggatagcttgcgcatgcatgtcgggacttttcttcggaatgttcaccctcggatgcaagataggggcggacaggcagtatgcgcccatgacgacgatgttctacatcttcctgttcgcgaccctgttcagtctgcctctggcggatgatgccatggtcctcgggtccttcgcaaatgcggagatgctcctgtacatacttgtcctgggattcgtcctttcgctgctcccgttctattgcacgacatggggcgtcaagagactggaggtcaccaaggcctccctcatatcggtgatggaactcgtcaccgcagccatagtaggagcggccgtgttcggtgaggaactctctgccccgaggatcgtcggaatgttcctggtgatcctgtccatcgtcatcatggatgtcaagatctgggggaagatcagggaacatcgcaggtcgaaaggcgtatcggcggacggacatacttaaccgttaaatacagaaagaataatcggcaactgcggactcatggtctaggggttatgacgtcgccttcacacggcggaggtcgccggttcaaatccggctgggtccacttgattattctaactttgctaactattttaactacaaacgcctacagaatttcaagaacagaactggttctttaaatattaattgcgtaaaatgcgtttttcgcaattaagaaattctataattgcgcaggcgcaatttaacaagagccacctatcaaactttaatattcggagtatgacgaaaggttatcctaataaaacccgtacgacaggtcgcaaatgcggccacttggcacacgggctacggatcgtttccacacttatcttcagtttatcttctgtaaactagtagaagataagtagaagataaaaatctattttagtggcactgactttcagcaagaggaagagcaaggtcgaggtcggtccgggagaggccctggtatgcgccatagccctcggatacgggaccacccagggggagtcgcatccgatcaagaggccggacgaggtctccaaatgcgggaccggcgtaccggagtggttcgcaaaaggagtggaatgcgctcttctggcacctaccgcgcttatgaaacagaacttcatgttcgaataccgggacaggaaggcatacgccaccagcaaagggatatgcgcccctgtgaacctcggcatagtgaagtatcatttcgaggtcggcgcaggaaaggacaacgtcgtctggggatgatgtcggcagccgatgataccctctgtccgtctaacatggtcgggccatgcccgaccgcccacttatgacaactgcttacggtaaaacaggtgggcctaagaagattttatcaaccatatcttcgcaatgatgtgtaaagaccggcgggaaaacatcattgccttgaagaatgttttaatatctaaggcgacatgctatattggaagatacatccaattaaataattggacttaccaggcgaacggaatgatgaacaagtgctgccgctgcggatacgagtgggccccccggtccaaagaaccactcagatgcccctcttgcaaatccaccagatggaacaaggaggcgatcaaggacaaatgtctccgttgtggcgcagaatgggtccagagagggagcgagtcccccaaatactgccccatatgccactcctccatgtggaactccgagaaggtgacatacacttgtccgaaatgcggccttacccgcaccctccgttccaacagccgcatagggctgtgcccggtatgcgaccgctacgtggattcccgccccaagacacagttcgacgatttccggccgaaggaggcgggggtcagcgacatcgtacgcatatggaccgacggagaaggtctgaccctcgtatatgtggacaacggacgcggcatgacgtacctgtatgccgaaggggacctggtggggtcgatcaacttctccagctggtgcaggaacaacaaactgtccatggaatacgtcctgaggaactatcaggaggattccctgtccgagaaactttccaaactggccatgtccatgctttcagatgacgaggccccgtccgaccgcatatccataatcgcagaactccgcggaataaccgaggagcaggcgatcatcgtctccatgcacgacgacgggatggaacccctgccgatctcgctcaaactaggtattcccttctccaccgtaatggataccctgaacaacataccgccgatatcgggcaaaggcatccgctccgacatagggaaggatgcgaaaccggacatgggccacagagacatcctcggtgacgagaaggtatgagcggttttatcaagtgacaggggtatggtccgtcgttacggagactcctgcatgataatagaatattggtcggatttcgcctgtcctttctgctacatagccgaaacgaggatgaagaaggccctcagggaactggacatctcggacgagtgccgcttggatttcaaggcgttcgaactcaaccaagatgcccccaaggtacctaagcgcaacatcgtcgaaggattctcccaccactacggcatgaccatggagcaggcacaggcacaggtggacaggatatgtgccatgggaaaggaggaaggactggagttcaactacgccaccgcccgcgggtccaacaccttcgatgccctcagactcaccaagctggcacagtccaaagggagggagctcggagatgctttcgtggaaaggatgtacaaggcgtatttcaccgagaacaggatcctcgccgaccgcgagacccttctctccatcgcggaggagatggggctggacaggaaggaatccgaagaccttctggacggggacatgtattccaaggaggtccggagggacgaacaggaggcgtactacctcggcataagcgcggtcccgttcttcgtcatcaacaagaagtacgagataccgggagcggtggaaacatcccagatgaagaaggtgctgatgaaggcgtactccgaagaggagacggaggaactgcagccgggaatgacctgcggcccggacggatgcggacctgccgggaaggactgaacccttacagggaaccggtcatccgaagatagtcccggtcgagcggtacggtgctgccgtccgccttccggatcttcgaatacccgtcctcgaagagctttctcctcgcccatccgacggtcctcccttcacttttttcggaatagtccttcggatcccggggatttccggcatattccgcatagaccttgccgaaacctccgtagaacccgccgtaatatccgacgggggcggatacatccgccttccaggcggtggacaggagcaatacggatgctatatgcatcagacgcctgtccgagacctccccgcacccgcccatcctcgtccccggcacgggcacacgtttcgccaccgatccgtggatgaatccctccttctcggaacccaggtaactccggacgatttccctcgcagagtcctccggaccgacgggctcggtacaggtgaccacccctatacttgcggacatcaggttcctgacggtctccagacggtcgaacggattgagccgggtcacatccccctcccccagtctgatggcgtggtatgccctcccgacccccgcgttgcgcagggatatgcactgttggcgggtgaggtcccctgtattgaccgctatgacgacgtcctcgggagcctcctccctggctaccctgactgcgccgagaaggtcctcgaaatcgaacgaatgtatcgtcatcagggatatgacggtcacatccccgtgttccgttatccgtccgatataatcgcgcagagtatcgtccgacatgacgaaatcgtccgcatccgtcgtaccgaccgcatatttgcagaacccgcagtcggcgatgcacgggcccgttattatcccgatctgtgcacctatctcccccgtgttgtcgttggcgatacgactcagcctgtctgcgaaacatacggtcatatccgcctcgggcgaatcttccgggaatccgagcagatatacacattcgtcctctgtaaggggcttcctctccgagaccttcctcagaagcgataccgccgcatcatccatgggcccgggaacatgtaccagaggataatcgtaacgtaataaggatggtggacccggccgggctcgaaccggcgacctccgccttgtaagggcgacgtcataaccactagaccacgggtccctgtgtccccttgaaagtagaggggatataaaagaaaagtggtccctcgaaccttaatctaaaatatgtgagatgtttatggatgtagcaagcggctgtagtccagtggttatgacgatggcttcccaagcctttgacccgggttcgaatcccggcagccgcaccaatgcttcttgatcgtccatatccgtacgaccgccttccgacacccctcgttgtcaaatacatccaacttctgtcattataacttcaatagaataaaataaaggcataccgtacggaagaacctatggtgctggagatcgacagttctagaggcgaagggggcggacagatggtccgcacatccgtagccttggctacgctcaccggcacgaccacccgtcttacgaggatcagagagaaccgtccgacgaacggactttctaaacagcacactacggccgtgaacgccgtcgcgaccatgaccggatcgaaggtcaccggcaactacatcggctcgtcggaactcctcatagaaccgggacacgaccaggtgaccgacatatccatggacataggctccgccggaagcataagccttgtgatccaggccaccatgctcgccgccaggaactacacgtcccccttcacccttgacctcgtcggcgggacgaacgtcatgtgggcaccgcccgtggactcctatccgatggtccttttccccctgatgaaaagaatggggatcaatgcagaactggagatcctcgaaagagggttctatcccatcgggggcggacatgtgaagctgaagatggatcccatcggcaggatcgaaccccttgccttggatgatctgggacagttgaaaggactgcacgggatctgcttcgtacagcacctctccgacaggatcggttcagacatgatcgaggcctgcaaacacgtcttcgagccccaatacgacatagacatacagttccagaggaccgagggtacgtcccgcggggccgggatggtattggtggccgaatatgagaacgggatactgtccagcaatgtcctttccagcaaaggccacagcccccagcaatccggattggatgccgccagcgacctcctgcaggagatgtccgccggatcgacggtcgacatacataccgcagaccaactcctcccatacatggccatggccgaggggaagagcagcttcatagtctccaggataagcaaacacctgctgagccagatggataccttggaatctttcctcgatgtgaggttcggtgtggagaggaaggacgacggataccacttctcggtcaatccgggggaaggaaactgacccagctcatgaaaccgttcatacacgtcaattgcgccatgtccgcagatggtaaactggccggatccgacaggaagcaggtcaggatatcctccgacgaggacatagccagagtgaaggagatgaggcgcaggtacgactccattctggtaggtgtcggcacggtcgtatccgatgacccccatctcaccgtaaagggcctttcctacgacgagaatccgatccgcgtggtcctggacacccacggacgcatccccgaggacgccagagtcctcgatgaccgcgcaccgaccgtcatcatcacctgcaaatcatgcgagaagaactgggggaacagggccacggtcgtacggtgcggcgacaacaggatagaccttcccgttgcaatgcacctgctggcacgtgaactcggcatcgagagcgtcatggtggaggggggaggagaggtcatagcctcctttttcagagacaggctggtggacagatacaccgtcttcgtgggcggcctgctcatcggcggcaggacggcccccaccccggcggacggcgacggatgggtcgcacccgagggcataagattggatctccagtcggcagaggtaatgggcaacggagccctcctcacattttccccgagatactgaccgtgcgcgcgcacattttataactgttcccgcagtaggagaacccataggaaaggcgaatcccatgaaggctagaatgaaggacggaagcaccggagacatcaaagcggtctggttcgagaacgggaaggtaaggatgatcgaccagaggaagctgcctttggacctcgtgatcgtggaattcgacgactaccgcgatgtcgccgaggccataaagaacatgaccacgagaggggccccgtgcataggtgccagcgccgcatacgccatgtgtctggcaggtctcgggggaaaggacctcgacgaggggccgcgttcataaaggccgcgagacccaccgcatacgacctgttctatgccacggattggatgtattccagactcaaaaacggagacgacccggtgaaggccgcagacgaatacgccgacatgaccgtggccaaatgccgtgccataggggaatacggaggggccttgatcaaagacgggatgaggctcatgacccactgcaacgcaggggcccttgcgacggtcgatgtcggcaccgccctcgcacccatgaggaacgcccacgatgccggaaggaaattcttcgtctacgcctccgagacccgtccccgtctgcaggggatgcagctcaccgcatgggaactcaaccaggagggtatcgaccacgccatcatcccggacggggcgtccgcctactatatgagccagggtgtcgacatgatcatcgtcggcgccgacaggatcgccgccaacggggatttcgccaacaagatcggaacattcgacaaggccatctgcgccaagaggttcggaataccgttctacgtcgccgcccccgtgtccaccttcgatttctccacggagacgggaaaggacatcgtcatcgagcagcggtccgagaccgaggtcaccgaagtgaacggcatgaggatcgcaccgatcggctccaaggccctgaaccccgcgttcgacgtcacaccggcggaactcgtcaccggtttcatcaccgagaagggcatattcaagccgtcggagatctcggagatgagggaatgaccaacgaatcgttcgccagaaggagactggcggaatgctgtcacctcctttacgaccggcatctcaccgtatccgcaggaggcaacatgagcgtacgtctcggtgaggacgagatcctcataacacccagcggcgtcaacaagggactcataagcggagacgacctggtcaagatggacatggatgggaacgtcatatcgggagggaaacccagcatcgagcataagttccacataggtatatacaaggagaatccggagacgaacgccgtcatccactgccatccgctgtactgtctcgccctggcggtgaaaggagaggacatcaaaagctgtctgactccggaaggggtcctcctccttgaccaggtcccgaccgtcagatacgagacgcccgggtcccaggagctggtggatgcggtcatggaatatgcggatgccccggccatgctcatggctaaacacggggccatcacccaaggcaggacgctggaggaggcattcaatcggatggaggaactcgagttccaggcacacctgcagatcctggcgggggatgccgccgaacttcccgtggaagaagtggccaaactcagggggatgagatgacatggccatattggtgaccaaatggttcggggtcttcctggttgacgacaagtccaacagggtcatggacaaacgcctcatgcccaaggatgctgatgcggccgcggagaagcttgcggagatccaaaagggttccatccttccggaggaaagggaactggcggaaggaaggacgaaactggccgttggcgataggagacagtccgaactggggaaacccgaactgtacgactcgtccttcatcagaccttccgattacgggttcgacgatgcgttcatgcacgaggtcatggtaaggctcggaaaactcaggacctccgaaccgatagccagggacaagaacctcgtacaggccatccgcgacctcgacgacctgatagaggtatccaacctgatgagcgagagactccatgagtggtacgggatgcacttcccggaactggccgacctcgccaaggacgacagatacgcccttctgatcgccaaacacggggacagggagggtatcgtggacgaattgggactggacatccaatccatgggggccgatttcgaccccgaggatatgcgtgcggtacagaacctcgccgacacactctgcaggatatacgacgacaggaaggacgtggaggaatacatcacgtccttggtagaggagatgtgccccaacatgtgtgcgatcctgggaggtccgctatccgcgaggctgatatcgttggccggaggtctggaaaggctcgcatccctgccgtcttccaccgtacagctccttggtgcggagaaggccatgttcagacacctccgttccggaaagaaccctcccaaacatggggtgatctatcaataccccgacctcagaaaggcaccctattggcagagggggaacatcgcccgcgccttggccggaaaggtcctcatagccgccaaggtggatgaatacaaaggagatttctgcggagacaggctcaacgccgagttgagaacgaggatcgccgacatcaagaggagataccccgaccccccgaagaagaaatcaccggcgaagaaacccaaccaccacggaaagggcaggaaccaccacggaaagaacaacaaacaataagccaaggcattgaattgcagcaattgttgcagaccggaaaatgcaacgattgctgcattccatactacgacgataccctcgggaggtacgccgtatcgcttcggggatcgtacactccatggccgagtttcccatggatttcccgggatcccttacggaaatggtcggaaaagacatggccgagtacatggatctgtgtaatcaccgcaccccgctgtccagaatccataaaaagtgtcaataagtatatattttaacgggctatggggaatccgattactatgcgccagaacatcattgttgctgagccccaatacgggaaagtgaagaacaaacggatactgtaagcgcatcgtacgaaaaaggaaggaattattatggcagagtgggagatgaaggagctcagggagctcaaaatcggaaggtacgtgaacatcgacgaatgcccttgcaagatcgtttcgataactacctccaagcccggaaaacatggatccgccaaggcaagcatcgaggccatcgacattttcaccggagccaagaaatccatcaacgcacctgtgagcgcaaaggtccaggtccccgtcatcgacaagaggaagggacaggtcatctccatcgacgaggccagcaacgagatccagatcatggacctcgagactttcgagaccttcaccatgcccatcaacgaggaccacgagagcgtccttaccgatggcgcagagatcctgtacatcgtggcgatggacaggatgaaactgatgtgaggtcggattaaaatggtgtacggggtgacctacgctgatgccgacgcagagtacaacgatgcggatgcggtgatcttcggggtcccgtacgaccacactgccagcttcaaggccggggcccgcgaggccccgaccgcagtgaggcgggcatcctataattttgaagagttccatttcgagcatgggctggatcaaaaccagcccgtggtctgcgactacggaaactgcgacgacttcatccttccggaggatatgatcgaagaggtcaagttcgcagtaggtccttgcataagggaggggaaattccccatcgtcatcggaggagaacattcggccaccataccggtcatccaatccttcgacagcaagaagatcgcgctcatgaccatagatgcgcatctggattccagagacgaatatatgggcacccccaatagccacgcatgcgtgacaagaagggcggccgaccacatcggtatagagaactgttgcgcagtcggagtacgggccatcggaagagaggaactcgaaagggacgacgtgatacctcacgtgaccgcattcgaagtattcgatcacggtatcgaatgggctgtgaagaaggccttggacggattcaaagcggataaagtgtatctttcgatagatatcgacggaatagacccggcctatgcaccgggaaccggaacacccgaaccgttcggacttacgccttatgacgttaaaaaagccatcaacctggtaggagaccgcttggccggatttgacgtcatggagatctgccctccggcagacccctctgggataacctcagtcctgggagcgagactcatcaacgaagcccttgccgtactcggcaagaacctcagacagtgagccacccctgctccatatataatatgtaaatagggaggacatcccgtgggatgccctctgaaatgatttatgcggaagaaaggaaggactccaccatcttctggtacttgtccgcattcttgatggccttttccttatccttggactccacatagatcctgaatatgggctccgtacccgagggtctggccaacacccagaagtctctcgagaccaatttgaggccgtccgtcttatccttgttctttatggtggcatgactctccaagaacttcatgaccgcatccttgaggtcgttgggacattccatcttcctcttttcggtgtaatagatgggaagagcggccagctggaaattcagaggaccgttgcggatgatacactccagcatcctgccgatggccatagccccgtccctgcaatactggtgatccgggaatatgagtccgccgttctcctcccctccgaagacgcctccgtcatccatcatcttccttgccacgatcggagatcctactgcggtacggaccacggtacccttgaccgatttcaccgtatcgtctacgacagaggaggtcgctacaggagtgaccacctctcctccgccgttggccatcactatccccttggccagaatggcgagggtcttgtccccgggaacataggtcccgttgctgtccacaaagacacagcggtcggcgtccccgtcatgggctatgcctagatcggcatgggtgtcgacgaccatcttgcacagatccgccaaattgtccgcggtcggctcgctcggatgcccggggaactcgccctggggattcccgttgatcgttatcgcccttacaccgagtttcttcagaagaagaggcgaggtatggaaagcggcaccgttggcacaatcgagaacgaccgtcagattggcggcccttatagcctccacatcgagtttggagacgacggcgtcgacatatgcatcatccgcaccgggaacgaacctgtatccgccgaccatattccaagggacttcggggatgatctcgtcatacttgtcctcgatggcggactcctgttccttggaggcctccgtcccgtcgggagctacgacctttatcccgttgaactccggagggttatgggaggcggttatcatgatcccgcaggctatggagtcgttcgtcttcacataatactgcaatgcaggggtaggtatggcccccaggaacaccacgtcgcatcccacagacatcaatccggcggatacggcggtcctgagcatatccgcagatacgcgggtatcggtggctatggccgccgtaccggggaacacgacaccgaccgccttgcccatctgcatggcgagcttgatgttcatatcctggttcacgaccccgcggacaccgttggtcccgaacatccttcccattcagacacccctggagataagcatgatgtttatggcgtcgccgcacgacttcccgctgtcggccgccatctcgatggcttcgatgagttcgtccaccagataaaggcctctgggatccatctccgacagatgggcatgctttatgcatgtgaaatacagaccgtcgattatgcgctcctgatcgttcagggaatcgatctctccgaagaccttcttcggatcggcattcatgttctctatggccccgacaaggaacttgatctcctcgatgagttcgtcggtcatgtgagcaagctccgaccagatctccacagggaccttggcgttggtctcgttcagaagctgcaggtatatcgcaccctccttcgcccaattggccaccttatcggtctgcctgacgaaacggatgagattctccctctcctggacggagagctcccccctgctgatctcggcgcagagcttgtcctcgatacggtccgcctccttctcgcaaagcatgagcctctcggtacacttcacggccgcgacggcatcccccttcaccatgcagtccaatgcgttcttcagctccgccacggtgtcgcgtacgaccatcacgtgccccctggcaccgatggtgacagagctctccttcctctttccgaaccagtccagaattcccttatcactcaaggcttatcgcctccgtcaatccttccttgggtctttcgaacacctgtgtcatactcttgttgaaaactatggtgaccgtttccccgaccttgggagggtccagattgtctgatacattgtaatcgacataatcctcggtctccgcgaccgtcctgaccctccaatatgtgcccatgtacaccacgttgatgatcttcgcacgaagaccgtcgtctgcggtatacacgttctccggcctcaccgatatgaccacgggatccccgttggacagatcggtcttctcggcctttaccgtcttacctcccctgaggcggactttcgtccatccgttcttggtacggccgtccacgtacccctccaggagattggtctctccgatgaaatacgccgcaaacacactctggggttccctatacatctctatagggctcccggtgtcgtgtaccgtacccgccttcataagaacgatcctgtcggagactgacatggcctcctcctggtcatgcgtcacatgaaggacggttatccccaattccttgacgatcctgcggatctcgtatctgagttccatacggaccctcgcatccaatgcagacaggggttcgtcgagcatgatgatcttcgatccggatgacagggcccttgctatggcgactttctgctgctccccgccggagagctcgaacgggaacatctgtgccctgtccagcatatttacgagttgcagatatttcccagcggtctcctcacgttccttcggagacttggcacggaccctcgggccgtactccacgttcttcatgttgttcatgttggggaatagggctatgttctggaagacgtatccgacatccctgtcttccagaggaacgtccgtcacatcggtgtcgtctatgtacaccctgccttcggtcggagtccatatcccggatatgacgcgtatgagactggtcttcccgcatccggacggtcccaggatcgttatgtattccccttcctcgacctcgagatttatgtctttgaccgcatagaagtcgccgaacctcatggaaacatgttcaagctttatcttagccatgtcagtcaagcctcatctcgtcttccaatccgttctccggcatcctgaagaccgatgccttctgcggctgccacgttatcgacacctgcattccgggctgatatgcctcgtatcttctggaggacctctgggaagacactattccgagtccctcgaccctcgtctcgacggttatcgtagccccctcgtacatgaccctctccacaataccgccgaaatatccgtcgggaaggaccttcggcaggtgcttgtcctgtacgtcggtcttagcccctaccacctctgggacggtcgtaccgaccttgaccgccacgacggcctcctcccccggctccatgtcgatgggtctggccttcaccacgatccccggcgatatctcgatctcggaatgttcggcatcccctcccacgtacttcccggagaacacattggaccggccgaggaagttcgccacaaatggagtcgcaggattctggaatatgtccgagggggtcccgacctggatgatcctgcctttgcgtatgatcgctatgcggtccgccacctccatggcctcgtcctggtcatgggtgacgtggatggaggtcagacccatctccttcaccatggatttgagctccttcctgagttctatcctcagacgggcatccaatgctctgagcggctcgtccaggagcaggatcttcgaatcggatgccatggcccttgcgagagcggtacgctgctgctgtcctccggacagctcccctggcatgctgtggaccttcttgctcatgtggaccatgtcgatcatcgaggtggcaagggacttcgtatcctcctcgctccacttcttgatcacgggagcgaaaacgacgttgtcgtagacgtccatgttgggaaacagagcatatctctgggaaagcatggtcgtcctcctctcgcttatcgggatgtccgacacatccttcccatcgaaaaggatacgtccggaatcgggctccgtaaggccgcagatcatcctgagggccgtggtctttcccgcacccgtcggcccgaggaggcataggtactccccgtccctgacggtgaggtccaacccgtcggatgccttgatgcccccgccgaactctttgtggagcccctccaatcttatctcaggcatgtctcggacctcccctgtgggtgatgtatctcaccaacatcatcatcacgaaacagatggcgatcaggattatggacgccatggccgcctccggatacgacccgttcttgaccagatccacgatatagatcggaacggtatcgaccgcatttccggcgatggcctgtgtagccccggtctccccgagactcctggtgaatgccaagatggccccggcgatgacggaggtcttgatgaccggaaggaggatcttgtagaacgcctggaacggtttcgcaccgagggtcatggccgtctcctcgtaggacgggtcgacctcctctatggcccccgttatgttcctgacgatgagggggtatgtgaacgagatatgtcccaatatgacgaggatcatggcagggacggaatttgcggtggtggcggaccagaacaatgccagagacacaccgagggcggtggtggggacgatgagcgggatgttgaccagattgtccaggatcttcgcgaacttcccgtccttgtgtctcgcgatgtagatggccaccggtatcccgaatattatgtcgaatatgaccgcgacacccgctatcagaaacgagacccctgtggtggagaggagttttcccgtatctatggccccgggatcggccagataggcgaagatgtagaaggacgggacgaggacgaagaggacgaggacgaggatggcgagaccgtccttgagcttcggagccgcaccgcggctcagtctcctgcccaattccggccacaccttctccgtcttgatgcccatcttggtgatgacgaacctcgccgccaccaggagcagcagggcgaggaggatcattatggtgctgatcaatatcatctcgggagtggcctcgttaggtgccagaccgatcttgttctcggtgatgtatgtgggtccggtgaaataagtgctctccacacccagtatgctgagggcgatgtatgtgccgcccgtctcggagagggacctcgcaaagcagaggatgaatcctgtgacgagccccgctctgaaaagagggagggtgatggtcctcacagccgtccacctgctggcaccgagggtcatggcggccgtctcgtaattgggctcgatctgctccagaatacccgatagggacctgaccatgtacggataggtgaatattatgtgcagaagcaccaacatcatgaaggtcgagagatggagtccgagtccggggatgtccacaccttcgggggccccccagaacatgaggacggaaagtccgagaacggcggtggggaacgccagaggcatgtcgaggagcgtatccaagaaattcttccctctgaaattcttcctgaccattatccaggccatgggaaggccggcgatgatgtcgaagaccgtgacgacgaatgcgagaccgaacgagacgccgacggccctccatatgaccgacatcttgtcggaatcggcaaggacatcgcttatgccgtcccaatcggtgaacatctgtgttacgacatatatggacgggactacgatgatacagacgaaaatagcgacgacgagcccgaaccatgccttacgggcgttcgcgttgtccgataccttgttgatcctgtccagaagggacataggtcgaccttcggaatatatcctcagaggatcgagatacttaccacgttgtttccgcggaggacgacggtcccgagccttctttcctcggtcccgggtacggtctcgaccgtctcttcgagagacatgttcatgaggtcgtcgaaaccgacgagcttgccttccatcaccctcccgtccttcaggaggagggagacgcgctttcctacggacttctctagcagagcctgcggcatggtcatatctatcgatatcccgtacctctccttattataatatattgtcgcgcgcgcaggagtcactggacgtcgttcgggtcctggggagccgactcgccgccgtcggcctgtctcatattggccgcgttgtcctcgatccacttccttatggccgccttgctgttgcttccgataccgaactgctcggcgaacttgggggtggtggacagctcgaccgtctgccccacggaccttgcggagacgagacccatgtccctcaggatatggacgtcctcgtaggcacgaggcccgcggaccttcaccagtttggactgcagcaccggctggttgtaggctatcgtgctgagggtacgcatgacccctccgggcatttccggtctggcgaagactccggtgaacttctgacagtccggcctcagcatcatcctgtatgccccgccggcgaccgatatcatgatggcgctcccgcggaaatcgtactccatgcggaggtccttgagggcgtatctcacggaggcttcgtcgagaccggtcctgctgacgatgtcctccaccttcagaggcgccgtggccgcgaagagggccgcctcgaccatcgtcttgtcttccaactcagttcaccgccgccgcctcgaccggcacggacgtctcgggaaccctgatctgtacggtgatctcaccgtagggaagttccgtctgatagacatccagcaggccgttcctgaccagatggaggacggatacgaacacggttatgttctcctccgcggacgatgtgtagaactcggttatgggcatcggacccgcacccatctcgcggatcctcctgtataccgcctccacagccctctcgtcgtcctcctgatgggccttgttctcgaacctcacgggggccttctccctgatcttcacacgggcggattccctggcctcggcgatctcggcctccttcttggcctcctcgaatgcgtcgagaaggtccatcatggtcacggggcgcggctcgtccctgacatacgccctcctgaacgacacttcgggcacgaccatcgggtcctcctctatgaagtcgaagtcggtctcgtccaccgcctcgacctccacgggaggttcggcggtcatacgggtcctttccgactggaggttcaggatcttccaggccatgaggaggagccttcctgcgacgatcatgtcgaacctgttggacgacaccttctcggagtacatccttgcaaactgttcgagatctatcgcccacgggtcgagacccctttccaggacgaggctgaacaccgcccttatggattcgtcgagggggtcgttgagcttctcccccgaacccgcatccttcaggatgtccaggtatccgtttatcctggcgaaggattcctcgtcctccgccatcgccttgtggaacagaaggtgctgttccatcgtttccatctgcatgttcccatccatcttcatccctctatgttgtcggagctcccctcctccctctgccttctcagagcctcctcctcgtacttggagacctcggctatgtccggctgcattatgacgcggcttatccctgtcgggggcctcgtcacgcctatcaggtggtcggccaaggtaagggtgaccttcctcagagacacctgtatgaactgtgtcctcgcggagctctccttgacccttctggccaccatctccgcattgaccgcgtccaggaacatgtcgacctcgtcgagcacatagaacggcgagggctgatactcctggatggcgaatatgaatgccaaggccgtaagggacttctcccctccggaaagggcctcgagcctcagcatcttaccgttcctgggcttggcattgatctgcagacctccgctgaacgggtcctccggaacgtccagggccatgaacgcctgtcctccgccggacagctgtgcgtatatcgccttgaagttcgagtccacggcatcgtatgcctccatgaacagtcccttcttcttcctgctcagatcctcggtgagtctgtccagatccgatatcctgttgttgagtatggccacctgccccatcatgaggtcatattcctgcttgcagatgtcgtaatcctctatcgcacgcaggttcacatggccgagggcatctatcttggcctgacactgccttatggccaccttcagcgagctctccgaagggatgggttccgggacttccacggtcagggccttcacctgctcctcatactgttcgaggttgatcctgctggtctccatctgggccgtctgactctgcagatatccgtccttggcctctatgccgttctgagccttctccacggcgttgtccaacgaataaccgttctgtatgagggcgtccctctcggccttcagatcctcgatcttggactccatctcgtcctgtatcctcttcacggcctccagcctgaccctgaactcctcgaccttggcggcatgctcggaggcggccttctcgtcctcggcgatctgggaatcgatcttggatatctgctcctccaaagcctccttctgcttgtcgagaccggacatctccgccttgagtccgccgatctgctgaagcaggtcggtgacggtctgcgtgtggcagtataccgcatcgcgggccttctggatcctctcctggagacctgcaggggctatgacggccatacggtcgcgtgcggccgtcctctcctccctgagggaatcgagtttcgagttggcggcatccagggcggctgcggcgtccgacagggccttctctgcggcggtgacgtccgacgtcctcttggaaaggacctcttctgcagacttcacacccttcctggcctgctccaaggccgcctcggcggcgacgatcttgcccttcatgtcgatgcccttggtaccggcggccctcatgaggtcgtcggtctgtctgatcgcatccctgagctgtctcagatcggacctcaggacggcgagggcctcgacggccttcctcatctccgcaccggcggcctccagggcggactggccgctgggaccgaactgctggaccttcctcttgtcgatggtacctccggtcatggcgccggacgcctcgatgagctccccggccttggtcactatcctgacgccgcccatgacctccttggccttgtccaacgtccccaccacgagggtgtctccgaagacgtaccagaacacgttggcatattccggcttgtatgtgacgaaatcggtcgcatatccgtccgtgctcttgagggcgattatggccttcgcacgcggtttaccgggaaggagctcggtgagcggcaggaatgtcaccctgcccagaccgttcttcttgagatattcgatgcaacgggcggccacatccttgttgtccaccacgatggcacccatcttgttgccggcggccacggagagggccgtctcatagccgggatcgacggtggcgagttccgccacggtaccgtgtatgccgggcatctgaccggattccttgagggcgaggatgcgggacatggcctcgctgcccttgttcatgctctcggacaccctcttctcggtggaaagacggttgaactccgcggtacgcttctcggcgatgtccttgagctcctcctcttccttctccttcgcggcctcctccttcttgagggccatgatctgctttccgagctcgtcgatctcgttctggggaccggcctgcctcttgacctcctggaggttccagtcggcatccttgacctcgaacctggcggattccaggtcctcctccgccttggccttggccacacgggcctcgtcgagcacggcctgggccccggccgccttcgcctgggcgtcctgctggacgtggcctgccgcatcgatgtccctctccagggtctcgagcctcttctggagttctgtcagctcccctccgtgcttggaggtctcctcgctgatcctcctctcctcctcctcggcggcggcgaggtcggcctgggccccctccagcctgatctgcaggtccgaaagattctgtgcggaggtcgcatactggttgcggttctcctccacatcctggacgaatccctccctgaactcgcgctgatcctcggcatcctccacggcggagtcgtgtttgctcttctctgtggcgacgtcgatcttggcctgctcgacatccccttttatcctcagataatcgggaccgaccttggcggcgatctcgtcctccttggccctgacggcggcctcgttctcctgtctctgtccgaggagggcggccttatccttcctgagtccttcgatgtccttctggatcagggctatgttcgccccgagactgtcgaaggtggccttctcgttgtccctgagcctgtagaccatctgggcattggcgatgtccagatccttcttggcctcgagatacaccttggcctgctcacggtccttctcgagtgcactgatctgcctctccttctcggcacggatgatgtctatgcgctccagattggaggacgcctcggccctctcccccttcgccttgtctatgtccgcatcgaaactggcgatgccggatatcccgtccaggatgcgtctcctctcgatgttgcccatctggacgatgtgcgtgacgtccccctgctgcacgatgttgtacccgtcggcgcttatcctcgccttggtgaggagggtgtcgaactcggagagggaggatttctggtcgttgatgaagaaatacgatgtgtagtcggtaccgttctcggagagcttgacgtaacgcgtcagtatgaccgtgtcgtcatcccagggcatgatacggtcgctgttgtcgaacaccaacgagaccttcatgaacttggccttcgacttggcggccccgccgtcgaagatgaggtccgtgatcctgctcgccctcaccgccttggagctcctgggccccaatacgaaaaggatggcgtccgctatgttcgacttacctgacccgttcggtccggtgacggccatatacccttccatcaaaggcacggtcacctttccgccgaacgatttgaaattttccagttctatctgttttagatacatcccgaatcccctttcgggacaatacagctacgccaactgcagtgcatcccatttcctgtttcacgctcacccggcgtcggctacattcgcgcgcatacagtctataaggtatagggccccatattatttaaataaaattataaaaaaggaaggtctgggtcatccgcatggcaccatctgtcagggagactgcaggagggggtcgtcggaacctgccttgaatatgaaacgcaggccggaaaggtcgtaggccttctcggcctcgtccagattcttgaggcccgtggagtccttcagattgatggttatggtgaaactgtagctggtgttggatgatacggttataaggtcggaaacgacccccgactggagcccatccgccgatttcccgaaaacgtagggcgttccgccggccgacgggacggagatcgacatgctgtctatcccgatccatccgagggatgcatcgccttccatgacggcatatacgcggacataactgtcgccctcggaactgccgtacacccggaatgtgtatgtcttgtcgctgccgatggtgatagatccgggatcgggtttcagcgtatctccgtccacggatatggccggtatcgcgaatgacgtcatatcggaggaacccccttcatacacatctatggcgatcccttcggacagcatggcgttgttctcgacggttatggaactggaaagggcatatgcgccacctatgccggcaagtaccacgaccgtcactgcgaccacggccgccgccaccttgtatccgcacgggaactccttgaaagaagaagcgatgcccatatcatcccttcctgtatatcctcacgatatcgctcacggcataggccgccacgatgagtaccgctatcatggctattaaaatgataggactcgatttgacgaaatggaccacctgacccagcagaggcgccacacccgtgaccttgcccaccaccatgtcagaagtgacttcctggacatcaccctccgacctagcatcaccgtgtgcggtaatagtgccagcaacaggatcgatcgctatgacgcgatgaacgacgacgacaccgctatagtggaacgctatgacgtccccgacctcgaattcgtcaagcatgtcctttccgtcgacatcctttatcatgacgaggctgtagatggggatggtcttgatgtcgtaaggctggtcgtccccgtccatcgatccggacacgatgtatctgacctcgtgggtacaggctatcgccgcgaccgatatgatcacacctatggcgacgagtacccatatcttcttcggactgagacactcctgtgcgttcacgacgttccccctaaatcatcatgaacacataatagtggtatttaaaatagataggaaaaaccgacaaagacggcatccggacatcagaacagttttctgctgtcgacgaactccgtaaggatatcggccacggaccctgtcacgaacgtggggcggatatcggacctcctgaggagttccagatcggtctcccccgacaacacgaggatggacctggtccctgcgtccgcggccatgcggatgtccgtggagagcctgtcgcccaccatcaccacatcctccggcccgacccccatctccgcggcggccatctccagcatcagacggttcggcttacccacgacggtggcctccctcccggtcatggactcgaacatcctgatgaagggtccgatatctatgtcgtaggagtcttccgtcggacacacgtcgtcggggtgcgtggctatgaactccgagccttgcagcagatagtggtacccgcggttgatcttaccgtaatcgatggtcgtatcgaatgtcagaagaacgatgtccggacggccttcggaggccatcctgatcccggactccgctatctcggccttcacatccggagtggccatggcatatacgctcctgccgcccctgttatcctttatgaaacggacggttgcgacggtggaggtgaggatctcgtcaggcgtgacaccgaaacccatcctgtccaacctgtcggcatagaactgccggttgtgggaggagttgttcgtcacgaacctgaacggtatcccgcgctccctaagccctgctatgaactcacgggcaccggggatcggcctttcaccgtggtacacggtaccgtccatgtcgatggcgaatccgatcaagagaggaactcctcctttatcatcgccatggtcatcttcaggtcctccctggcattcttcttgtatacacatgccatcggatggtatgtgggtatgaacaggaccttctccccgtccacatcgatatactgccgggtattgaccaccttggccatcggcccctcatatcccagcaggtccttgaccgcggacttcccgaggcctacgacgaccttcctccccttcagctcgctgttgaggaacggacggcaggccgccatctcttccggcatggggacgcggttcatagggggcctgcatttcacggtgttggttatcatcacccggcccctttcgagaccgacctcctccatgatcttgttgaggatgtcgccggcccttccgacgaaaggcttgccctggaggtcctcgttctcgcccggtgcctcccccaccaacaccacgggggacccgaggtccccggtgggcaggacgaggttggtacgcttgcggcagaggtcgcacagatggcaatccttgtcgggagagatcattgcttcgcacctttcaaaaggtcggaccctttgacgagggagttgagctgtactccgatgctctcgagattctcccttcctccgccttccctgtcgatgacggagaataccttctcgaccttgacaccctcggcacggagggcggcgatggccttcatggaagaaccggcggtggttatgacgtcctcgatgaccagcacgtcgtcgccgggactgaggtctccttcgacgagcttgcccgtaccgtggtccttcctctccttccttaccatcagaagaggtatgcccgtctcgagggacagggcggtggccagagggatggatccgaggacgactcccgcgaccctgtcgggatgaattcccatctcctccatcctcttggccatcgtctttgcgatgacggagaggacggcgggcttcgtactcgccttctttatatcgatatagtaactgctcttcgccccggatgccagggtgaaatctccgaactgcagtgctccgcagccctccaatgctttcttgatgtcttccatgtgaatcaccagggttccttcttgagacccatcctgtaacctacgatattcacgctgcggtggatggcgaacatcaccacgatcaggaatatcaaggcggctatgtgccacccctctatgtaatgtgcatagacccagtcggggaagaagagggccgtcaggcacatggcgccgatgacgaaatcgtactgatcgagtacgggcgccttcgcacctctctccagtccgagccttctcttgatgaatgcgccgcagaggtcgccgaggaccgctccgaacgacagcgtcgcaaggacgccgatgttcccgtagaaatccccgaatccccaataatcgctgtcgctcccgcagagagcggctatccctatctggataagtcccaaggctatgccggagaacgcccctccgaagaagcctctccaggactttccgtctccgaatatcctcttcccgcgccaactcctgccgaaatccatcttggtccctccgccgaaaaccactgccgcggaattgggcagcatggcaggaaggaacagccagaatccggtcagcatgatgacgattacatccaaggcgtccatatgggataagaacatactcccgcattctttaagggttttggcgaccgcagagagggtgtacggaaagcacccattccaataaataacccggaatatatcgaaggacgataccatgctcgtgctggacagttccgccttattctccatggaacagcttcccgaagaagaatcctgttgccccccgggcgtcataacggaactgaggaggtacaaggaccacaggctggacctgtggggggaccttctgcatgtatccgaatgcacccgggaatccgtaagaaaggttgaggaggccgcccggaagagcggcgacctcggacgtctctccccggtggacataaccgtactggcacttgccgtggatgtaggcgggacggtcatgaccgacgactattccatacagaacacggcccgcatcatggacataccatacaaggcggtcggtcagaccggcataaccaaggtcgagaaatggaattaccagtgcatcggctgcaaaaaatggtacaaggagaagatggaggagtgccccatctgcggatccccgatgaaggcccacagaaaacgctgatcaagggaacaggtgcttgcatctgatgagcttgctcatcctgcgggtacccaatatgctcatgcacagggcggtgctcctgtcactcctgaatgcgaatgcgtcggcgagcctcttgttgttggcggcgatatggagcggtttgtacaggacgtccttccactcggcctcgtaatcggataacggtgcaccgttcaagacgttctcggcggcggcgatacccgccatcctcccggtgatcatggcctggggtattcctccgccattgaccggcatgacgacgcctgcggcatccccggccagcatacctctcccggacaccgtccttgatatcggaccttcgctcggcacatacttccccttcaacggggatatgagtttgagcccctgcatctcgacgaatttctccatgtattcgcggagtgaaccgttggagaacttgggagagaaaccgactccgacgttggccacaccgtccttggggattatccaaccgtatgctccgggggctatgcgtccgaagaacatctgtatcacagggtcgaagtccccttccgcctgggcggtcacggcagggtagcagttcctgttgggcggaagacccagacttttggccacacgtgaattggggccgtccgcaccgatgatgaccttataagatatgtctccggccgaggtctttgccacatcccccgctatgcctctgaacctgcatccggtgatgagttcggcacctgcatcgacggccatgtcggcatggtattggtcgaacctgtccctgtccgtagtatagcctgtgaacgggaactgcctctccttctccttcggatccagaagccttatcccctctatgtccctgcatttcagagatgacgggacatcgaacagcgtatcggtgtcggagagattcgggaacatgtccttgatctctgcgacggagggcatgagttccccgcaacgaacgggggtaccgacctcgtcgcgcatctctataagggtgacctccacccctttctcagcggcatatttggcggccatgctgccggctggaccggaaccgaccacgaggacatcagtttctatcgaagtcaaatgtatcacctgtcacgggatacgaagaaatctatcaatccgataagcgatctcttgtatacggaatcgggtgcgaaaccgagggaggctttcgcctcgtccgcgatcgctctggctttctcacggcaccttgctatggaatccgtcttttttatgagggagatgcattcggcggcatcgtcgtaggtggagttcggatttgtgaaaatctcttttacacgggacccgacgaccgggtcctccatggcgtagattatcggcagagtgggtttaccttcgacgatgtcgttacccaccctcttcccggtggaactctcgtcgcctgccacatcgaggacgtcgtctatgatctggaatgccagaccggcattgtatgcgaactgtcctatcttgtcgatgtcttccgcatcggaatgtgccagatatgaaccgcattttcctgcacattctatgaggcgtgcggtcttccctccgatgatcttcatgtactccgactcatcgacgacgacgttgcgctcatatttcttctgagagaactcaccggcggcgagaccggatgcggcatccacgatatagtcgatgatgctatcggtactggcaccgagcagacggaatccgagggcgaagagatagtcgccggcgacgatggatttccctatcgtatattccttgtatagcgccttggcgcctctgcggagatcgccctggtcgttgatgtcgtcgtgtatgagcgtcgcgttatggataagttcgatggatgcaccgacatctatggccttcttggcatctttcccgccacagacatagtaggaaaggatacacatggcaggccttatcctcttcccgtgattcctaagaacatactggcacatctcagtgagctcggcattctccgaattggtagcgtcgctcataaccgtctctactttatcgagatcgaccgaaatgcagtcatgccaggaatctgccatcggttgtcaatggacggaccgtacttaaagatactgatagttccagagaaccaaaagcatgactgtgtccgattctggcactcggcatcagaacgtataggctacaacggagacaatatgtctattccgatcatcctatacccgataacgcagtgtcactgcaacctgcttataccgtacatctacgccccgatactgcgtcgatacaagggtgaatggaatagatggtacagctgttcgagaccgatacccgcaccgtcgctccaagacagtgccagtgaaagaatccgtcgaatcgtcttcatacctatggggcctatgactcggacatgcggatcagatgggctgaagatgggaaagggtgatttcagccccaatgcccctgcatgacaggcctcttgtctccgttcttgtctgtcgatcctcgatggagaaagaggcctctgcaatgaaatcgtttgggcacctgaactcgactaaggtcaggccggttcccatttgcatcttacaggcgagacgatggcgttctctgccttgagctccttgaacgccttgtctacttcagccttatcgattccaaggatctttgccacatctcctgcggagagaggcttccctgcttctttcattgccttgatgacgtcatccttgactgccatggaactctgtaggtgtcctcgatttaaaacataatctttcgactaatgcaaactgtgtgagtctaacatcaaaaagaaatgttcccggcccgaaggccggtaagttgtttcagttcactctcagatcaatgccgctgcagcgtctgcgcagaggtcgaggatgaggtcggggtagacaccgaggacgatgacgaggaccgcacataccgcgattgcgatagcgaaggtcttcgggatcttgatctttccagaggcgtcctttgccggcttctcgacgtacatggccttgatgaccctgacatagtagtacagggagatcgcggagttgaggatggcaacgaatgccagccatacccactgggtcatgacaccgcttccgtctgcgtcgaagatcgctccggagaacaggacgaacttggaagtgaatcctgcgagcggaggtactccggccagagagaagaggaacagcatcattgcgaatgcgaggacaggtgccctcttcgcaagtccgttgtagtccgtgatcttctcgccgacaccgacacagatgagtgcgccgacgaccaggaacgcaccgcccttcatgaacacgtgggtgaacatgtggaacagtccgccggtcagtgcgtactcgctcatgacggccatgacgatgaggatgtatccggcctgcgcgatggacgagtaggcaagcatcctcttgatgttgttctgcgagatggccacgatgtttccgacggtcatgctgaatgcggcgatgatagcgaagatgtactggacgatctcgatatcgaagccggccatcgactttgcgacgacgaacatgaccaggaagatcttgaagaacacgaccagacccatcttcttggatcctgttgccaggaagatagagacgggggtggaggatccctcatacacatcgggtgcccacatgtggaacggaaccgctgcgatcttgaatccgtaacctgcgatcatgcagatcagaccgacgacgaacgcccagctgtatccgttggccgcaagtgcgggtccgagctcggacagggtcagggtctcgagggatccgtagatcatcgagataccgtagatggtcagagcggtggagagtccaccgatgaccacgtacttgacacctgcctcggcggcgcgggagtcgttcctcttcatggtgacgagcacgtaggaggagatggacactgcctcgactccgacgaagataccgaccaggtcggtagcctcgccgacgaacatcattccgacggtcgcgatgagcagcagggagttgtacgctccgtagtggagagtagtggtctcggtgctggagacggacacgaagaggacgatgatggacactgcctggaacagcaggatcatcagtccgctgaagtcgttgtactcgaacagtccctcgaacgagctgtattcggcgggatagttgccgccggtcagcatgatgaggttgatcgcgatgctgatgaccattacgatcagtgcgattgcggtcacaggcgctttcttcttgaatccgaagtagagcgccggcatgatgagtgctccgatgatcaggacgatcatcggagcgatcggggaatagctcccgaatatgtcagtaattaccgttgcatccatttcagatcactccagggaagctgtacaggttgatcatagtcagtgccagttcgggccatactccgtagagtacgacgagcagggcaaggactccgaggcatattgcctcgatcttgtcaacatcgtgcacatgggtgaggtcgattttcttggtgagccttccgaacagggtcctctgcatcgcgaacaggtagtaacctgcagtgagcagcagggacagcagacagaagaccagcaggtagatgacgtcgttatcgacacaccagtcgtagaaggcgtagacgataccgaactctccccagaatccgatgagtccgggaagtccgagggaggccatgaacgcgaacatcatgaatgtggcgtagatgggcatctttccagccattccaccgagcagggggatctccctggttccgatgttgtgtccggccattccgcagaccatgaagagcatggcggagatgagaccgtgtgcgaacatctggaagatcgcgaactcgataccggtggtcgtgaggcatcccatggacaccattacgagacccatgtgggagatggaggagtatgcgaccatcttcttgaggtccctctgtgcgatgcatgcgtatgctccgtagatcatagccagcagacccatgaagatcatgatgctctgccagttctgggctccgagctcgaggttctcgatacataccctgatgataccgtaggaacccatcttcagcatgactcctgccagcaggacggatcctgcggtaggcgcctcggtatgggcatccggcagccaagtatggaagggaaccgcgggcatcttgacagcgaatccgaagaacagaagtccgaagaccagagtctggaacacctcgttgaagaaggggctcgcctgggtaatcgctgcgaagctgaagtcgaccacgccaccgttgatctccgccgcctggaatgccagggcgaagataccgatgagcatgaccagcgatgctacgtgggtgtagatgaagaacttgatggcagagtagtgcctcctcgggcctccgtaccaggagatgaggaagtacatcgggatcagggtgatctcccacatgatgtagaagaggaagtaatccgcggcagtgtacactcccataagtccaacctcgatggccagcaacagcgtgaagaagtaattggggcggtcgccctccttgtaggagaacgccaccacgatgacttccagcacagcggtcaggaagaccatgagtatgctaagaccgtcgaccgtgaagagcaggctcatcttgagtccggcggaatcgatccagttcgcactgaagtcgaactgactgaggtcgtcaccgccaagcatgatgatggcggtaagaccaagggtaatcagggtgaatacgaacgcgacgatcctggcgtatttctgtttctccccacccatgaacaaagtcaggatggctccgatcagaggcaccagaatgattgcgggtagtatgaatgaaccgtccatctcagagacctccgaagatgtagacgaatgcgatcgcaaccacgaagagtgcgacgattccgcctaccaccactccggcgtaggtgtggacgtttccgttctgagccttgctcaggaggtctcctccgctgatgacggcgttggagagaccgttgacggatccgtcgatcacatgcctgtcgaagtagtccactcccagagccacgtcgtatccgagcttccaggagagctggttgtagatctcaggcaggtaccacctgttctgtatagtcttgtacagccaggaggttccgttcttgctgacgcagccggggttgaccgtcttcttgacatacatgaggtaggccagtccgatcgcgatcaggacgagtgcgatggttaggtaggtcttccagttggtgaagagttccacaacccagtggagtccggtctccgcatgtccgccggcgacctgccaaacctgagttgccagatcgtagctgatggtgaagacgccatcccagccgaagagcagggtgaatccgaaggcgaatgcgaacagagacagtacgcagaggggcagggtcatgcagcgaggcgactcgccgtggcagtgctgtgcgttctccctaggctcgcccttgaaggtcatgaaccacagacggaacatgtagaatgcggtcatgaatgcggtgacgattccgaggaaccacagcagtgcgaagcagatgctggtaaggtctccggtctcggtgaacgcttcgaagacgacatccaatacgaggtccttcgaccagaatcccgcgaagaacgggaatcctgcgatggacagggatccgatgagcatggttatggaggttatgggcatcttcttctgcagtccgcccatgaggcgcatgtcctctgttccacatgcgtggatgacggaaccgctgcaaaggaagagcagtgccttgaagaaggcgtggtttgccatgtggaggcatcctgcggtgtatccgagggctccggccgccatcagagcggtgttaccttcgttcattccgatggcgaagagatatcctcctgcaccgatggagaggaacatgtaacccagctgggacagggtcgaatatgccagcactttcttgatgttcatgttgttcatcgccatggtggcggtgaagaatgcggtcactcctccgattatcgctacgaacagcattacttcagagttcattgcgaacagcgggaagcaccttgcaacgaggtatactcctgccttaaccatggttgccgcatggataagtgcggagacggtggtaggtccggccattgcgtccggaagccagtccagcagagggaactgagcggattttccgatggcaccgccgaagatcagcattgctgcgaggaacagggtgtcgggatctgctgcggcgaggtttgcgccgttgaagacgtctacatagtcaaggctgcccattgcctcgtaaaggacgaacagacctgccatgagacagacgtctccgagcctggtgacgaggaaagccttcttggccgcggatgcggcgttgtcggccttgtcgtcgccctcggggtggttgaagccccagaatccgataaggaggtaggagcagagacccatgacttcccagaagatgaacatctcgacgaggttgctggaagcagccagtccgagcattccggtaaggaagagtgcgacttctgcgaagtatctcctctgcctctcgccctggtcgcccatgtatccgagcgagtagatgaagatcagcatcgagatgaacgatgcgaagagcatcatcaggcaggacagggagtccacgtagtaaccgaggttgatgtcgaatccaccaagggagaaccacttgatggagctggtcacgtatccggggtcgctgtaggccgagctggtgaagaagtcgtaagacacgagcatcgacatcacgaaggcgaacgcggctccgaagattgtcacatatccgccgtacttgagcttcgggcccatcttctttccgaggaatccgacgatcaggaagcacagtatgggtacgagcgggacaagccaagtatagtctatgaagctcatcttaccacctcattgtgttgagatcgtcagtactgacggtctttctcatcttgtatgcgttgagcacgatggcgataccgacggctacctctgcggctgcgacggagatcgtcatgatgacgaacacctggccgagggcggcatcgatgaaggtaccgtatgcggagaacgcgatgaagttgatgttcgccgcgttcagcataagctctatgcacatcagaacgatgatagtgctgctctttgtcagaacaccatacgctcctatgacgaacaggatagcaccgaaggtgaggaagtactcaattggaatcatctttctcaacctcctctcttgctacgcatattccgccgatcatggctccgaacatgaggattccgaggacgagaaggacaggtccgtacttctcgaacagctcatagttcagggagctgtggtcaacagtctcctcgccggtgacgggatccgtctcgacgacgccgttgaaggggacatcgttagcctcgtccccgtagttgttccagtcggtgacatagatggacaccgccaggattgcgagcagacccgccgcaagtgcgactgctgcagctgctctcttattcatctgaatcatcctccaggatgtacttacgggtcagcatgatgctgaatgcgaacaggatggtgatcgcaccgacgtagacgaggacctgtatcacaccgatgaactctgcttccaggaagaagtaggccacaccgaccgtgaagaacacgagtgcgagatagaacgcactgtggacagggatcctgtcggttacgacatagacggccgccgttattccgatcgctgctaggatcacgaatgcaaggaggtcgccgttgcaccagacgtagtccgcaaagttgcagatgccgtcccaaatatcttctaatatagccatcacagcacctctttgatatgcagggcgtccttaggacaggcgtccacacagttctcgcagcagatgcacgtctcgttgttgatctcaggccacaagatggggcgccctttggcgttggtcccgtgctccaccatgttgatggcattgacggggcagaccttggcgcacttcttacagctgatgcacttcgaggactcaagttcagggcggtcgatcatgaagggcttgaccctcctctcgccgtttccggacttgaagtcagagatgagcgtctcttccagaacgatcttcattccctcggtcgtcttgtcgtaggcaagcctgcgcggaccgtagatgaggtccgaacgggtgtactctgcaagctcgacgatgggagagacggtcattgcatccaccgggcagtattccgcacagtaggagcagaaggagcaccttcccatgttgacctgcggcctcttgacgttgttgccttcgtcgtcgggggtgtcaaccaggattatggcgtcgcagggacacatcctggcacacattccgcatccgacgcacttgttgaagtcgagtgccgggcgtccgcggtagttgtcggggttccaaagagcctcgtacgggtagaggacggtgacaggtctgtggatggtagtcctgatgaggaccctgcagcacttcacgatagggcgcatgatccacaggtccttccagttcttgtgccttccgtccctgtatttctcaagatattccatagtcatcagaagatccctcctaccttaagcagcaggacgaccaccaggttgacgatggacagaggcatgaaaaccttccatccgaggttcaggatggtatccgtcctgacccttgctacagccagcctgaggatgatcatgagcaggaacacgaaccaggccttgagcaggaacacagcctcgggcacaggccaccaggaggtccaggatccaaggtctatgaacggcagggtccatccgccgaagaacagaatgacgatcattccgcaggagcaggctcccctgaggtagtctgccagcatgatgagtccccacttcattccggcgtactcggtctgccatccctcgacgagctcggattcggcctctgcaaggtcgaacggagcacgctcggattcggctgtcgcgcacatgaagaacgtgatgaatcctatgaattcgggtatgatgaaccacacgttgtcgtactgggcgttgacgatgtcgttgatgttgaaggaaccggcgagcaggcaggtggtggcgatgacgatgaggataggaacctcgtaagccatcatcatctcggccgcacggatacctccgataagcgagtacttgttgttctgagcccatccggacacgaggatgaagaacggtgccagagcgtagagcgccatgatgatgagcagtccagtcccgtagtcgacgacgaaccacctgtgggacagggggatcatacagtcgatgaggacggaggtgccgatgatgagcgccacagtccaccagtatcccatcttgtcgaccttggtcgaggagatgttgtccttcatgaaggtcttgaatccgtcggcgacgcactgcaggaatccccacataccgatcatggttccgcgtctgtccatacccctaccgaggaccttacgctcctcccatagggaaactaggacggccacgaatgcgacggcgaagacgatgaccatgaataggaccagcgcgaagaagttgctggtcatgtcacagacaagccactcggagacgccgttgcccgggaagatcaggttgatgagccaggcgagggttccaccgatgatgtcccacagtttgagggcgatatcgtacggcaggttgtagacgtcaccgaacgggtagtaagggttggccagcgggtcagggtagctgatccagtcgagaagacttgtgtaaccggtcatgatatcacctgtcggtctctccaagacacatatcgatcattgccatgatgactggcacatctgcgatcctgcatccctggacgaggtccttggaagcagagacgttgacgaagatagggctgcggaccttcagcctgtagggcttgtcggttccgtcggacaccagatacatcatggactctccacggggatcctcgagcctggcgaaatgcctgcccgcagggatgttcatgggggccttgagcctgtacggggcgttctttccgagcgccttgatcttctcgacggcctgcctgatgatcctggtggactggaacagttcctcgatccttaccatgtaccttgcgtaggaatctccagcggtcagtactggcacatcgaaatcgatcttgtcgtagttgtcataggggtcgtcgcggcggatatcgaagtccactccggttccccttgcggcaggaccggtgattccgaggttggcgcacttctccctggtcaggataccgttgccgatcatcctgtgggtgtaggtggagttgtcgtcgatgataccgatgatctcccagagcgccttgtcgaagtggtcgcagcacctgatgatgtccctgtcgaaaatgtcgggggtgtcgttcctgactcctccgatacgggggtagttggtggtcatcctggccccgcagagcctgacgttcatatccatccagaactccctctccctggaagcccacaggaacacggtgaggtttccaaggtcggttccgacggctgcgagccacatgaggtgggactgcagacggttgacctcgtcggccacgatcctgatgtacttcgccttctccggtatctccatgtcgagagccttctcgcaggccatacagaagaggtgggtgtaggtcatagatgcagcatagcagagacggtccgccatggggatgatcttggggtaggtcctgttctcgacctctttctcccatcccctgtgaaggtatccgacgatggggtctgcgtcagtgaccatttctccgtcgacctggatcttgagggtccagagaccgtgggagaacgggtgctgcggacccatgatgatccacatcttgtcggtatccatctttgccgtctcggccttgaacaatgcttcggtagcagcatcgacagggagactgccttcggcgatagccacgttctcaagctgccgggtctccatagatggagtcttggttttatcttcgtcagacatcattcccatcccctgagcttgtaggatttcctgaaggggaagaactcgtaggtgtcgggcgtaagaagcctctcaagcctcgggtgctcgtcgaatacgataccgaacagctcccaggtctccctctcgtgccagttggcgccgccccagatgtcggagacggtgtgcacgtggaggtcgtcgttgggcagatcggtagtaatctcgaccatctctcccttgtaggtagtgtagttgtcaatgtggtagacgacctgcatgtagtccttcatgtcgacaccggctatggaggcgcagtgctcgaatctgagttcgtcgtggaggaacttgcagaggtcgtggatgatggccttgtcggccttcacgtagaccctgcgggtctcggtaccggtgacggtaagttttccggggaactggctctccagtttccctttgatctctccttcccaggagtcctgatattcacgaatttccgtatccatgtcagcaccctgttcagtccttgaggaatgctcctcttctgaagtagttgtcaatcttcttctgcaggagcatgaaaccgtcgatcatagcatccggccttgcggggcatccggggatgtagaggtccaccggaacgatctggtccagtccctgtacggtgttataagagtcgtaccagggccctcccgagatggcacactcgcccatggcgactgcccacttgggtgcgggaatctcctcccaaagcctcctgatgtgggggcggatcttcttggagatccatccgttgaccaggagaatgtcggtctgcctgggagaagacctgtagatcattccgtaacgctctgcatcaaaacggggggcggaagcctgcgccatctcaagggcacagcaagccagtccccagtgcagggggtgcatcgagttcttcatagcccaggcccagatgggtccggtgagtttgtcgatggtcctcctggtaccggaactcatgaggtcgttgatcatggctgtagaccagctcatgaactcatcggcactcatggccacggcgtgcgggtagaggctcatatccatatgttttcctccttcttcaaagagtacacgactcccaaaagcatgattccgaggaagatgagaagccaaacggtagcgtttgtagacaatccgtcaaaggcgacggaccagataagaaggaacgtgacaatcaggtcgaataccacgaaaatcaaagcgaaagcgtagtactgcatcctgaactggatacgcgtatttcctatcggggtcgaaccgcactcgtatgtctcctcggtccactctgtcgacttcgaaggcctgatgaacctcgaaaccaaccatgccaatggcgcaaatccgagggacattatccctacgaataagaatggcaagtagcttgcgattagtgacatcggctcttgcgatgttttctttctatataatggagaagggaaataatgcgcacttcatttataaatccgaatcgatttaagaatttaatcaggactaaatattctttaaagaattatgtcaacgcttattataaggggaagcggttggacgccccatggcagtcaagatcggattcatcggagcgggcaggatggccggcgcgatgatcaaagggctcatagccaagaacgtgtacggtccggaagaaatagtcgcctgcgcccccaccaaggagacccgggacagaatgacccaggagaccggaataaggatgttcgacaaagcatccgacatagccggtctgacagacgtcctcgtactcgccatcaaaccgaagaacatcgccccgctattcctcgaggagggcgtggatcttaccggggaccacctcctgatcagcatagtcgcaggagtcaagatcaagaccctgaaatcatatgtgccagattccagaattgtgagggtcatgcccaaccactgctgcatggtcctggaaggcgccgcgggatatgtcatggacgagacgtgcacagacaaggacagggagaccgtcaagaccgtcctgtccgccataggattggcggaagaggtcagggaatgcgacctggatgccgtcacggggatctgcggaagctctccggccttcctctatatggccgcccaggccctcatcgaggccgggaagaaatacggactcaccgaggagcagtcgaaggtattggcggcacaatccatgatcggagcgggcaggatggtcctggagtccgggatgaccaccgaacagctcatagacggcgtgtgctcccccggagggaccacgatcgagggcgtcaaggtccttcgcgaagagaaattcgaggaggccatgatccactgtgtcgacgccaccgtgaaaaggtctgtagagatgggtaaagaataaaagtgccagacttgtatttttaatgcacggcaggcttaatgcctgccgtgtatgagactctttatgaggcctgctccgatcctcgggacgttcctccagatggaaccggatgtccaatccaggtcgtttttgtcggtgatggtgttgttcatcatcctgaccccttcctctttgatgtcccagagcttggaatccctttcctccgggtcctcgatcctcaggatgtcgtctatgcgatacatgatcccgcgggcgacctccgtccgatcgttcctttcatctgcggccgcatcgtcgatgcgccccgaatcacgttccgcattcgtaaggacgatggccgcatcgtacgaggtgtctgcaatctggtcacggtccatccagacggtctcataggataggacgtgtttccaagagggactgtccaacagcctcctgtggtcctccaaggtcctcgcacggagcttgtatccccacttctccggctcctcgaaagccctgctcccgggatccacgaacggggcgaaaggagagtcgtagatgaacaacccgtcgtccttatcgacgatgtcccagaggtgcttggcatcggccgccgtctgcatggccgactcgcgggtctgctgggggagccccgtcatgaagaagaggtcgaagcggctgcacccgttcctgaaagcgttgggcagggtcttctctatggcctcgttagtatatcccttgccaagtgccagacggacggattcatcgaacgagtccggagagaactcgatggaccaacctccttcgaacgtacggtctatgttcgagaaatgttcggcgctggcaccattgaataactccaccaccacgtgattgtctatacgcctctccttggctgccttcaggaacctgtcgcaatagccctgtcccgcctgccttatgtcccctacgatgaagatcggggccttcatgtagttggatatgccctccatgtcctcggcgagcttctcggggctcctgaaggcgggatggcttctgcaacacacccttttgttggcggagttcgaacctccgcattcggcacagttgacggtacatcccctcacggtgaagaccgaagtgagagggaccttgtcccagccgtaccatggaagcgatcccgtcacgtccatggtgcgcatgacgttcttgatcatgacgccgtagtcgaacactatgttgtcgagatcctcttggacgtatgtcagaccgttgtcgtggaccttgcccccggcatccttccatacgagattcgggacggatgaaaggtcctctcccttggacagggcctccatcatcttcaccgtggggatctccgtggtatcccccctcatgacgaggtccacctccggacggcgtatcagctcgtcatagaagtacgatgaagtgaatcccccgaactccgtcctggcgttcggatggtgtctcttcactatcttggccaactccagggccccatgcgcatggggcatccaatggaggtcgatgaagtatacgtcggcgtcgagcttccgtatcctctcctccgcgtcgaacttctcatcggccagcataagaccggcgatgttgacgatcctggtcttgaatccggccatctgcaggtatgtggagatggtcatgaaccccatggggtacatctcgaacacgggggacgagggtatgacgtcgctcacgggaccgtagaatatgggcttcttcctgaaatcatagacgctgggggcgtgcaggaacacggcatcgtaatggaccgttccctcacctcccgtagcgtctcacgcgctgctggtacgtcctgatggccctcagaaggtcgatatgacggaatcccggccaatagacgtccgtgaagtacagctccgaataggcgagctgccatagcaggaagttggatatccttacctcccccgacgtacggagtatgaggtccggatccggcatgtccgaggtatagagatgcttggaaagcatgtcctcggttatctcgtcgggaaggacgtctccgtcctggacctttctggctatctccttcacggcgttgacgatctcctgccttccgccgtaggccagacatatgctgaacatgaaatcgtcgtagtccttggtcttctcatcggcgtagtctatggcctcgcagacatagtcggggagcttgctcctgtccccgaggacgcggacgcggacgcggttggttattatgcgggggtcttcgacgatctccctgagggacccctcggccatctccatgaggaagttcacttcgtcctcgtccctgctgaaattctcggaggagaatgcatagacggtgacatacttgatatcgaggtccaggcaccaatccaggagctcgtggatcttcttctccccggccttgtggccggcgttgatgtcatcacctaggaattcgcgtgcatagcggcggttaccgtccattatgatgcctatgtgcttcggcatggggccttccttgacctccttgtcgagattcttctcgtaggtggaatacacctgtttcgagattatgttcggtactgcagccatttccggaatctccgtgtttcacatcaccaggtcagggaagtcctcgggaacgccggcggcctccggtccgaggtcgacgcagcctatggcggccacggccccgatcgtcccgtccgtgccggtgatgctgatgatctgcaccccgcactcctcggccaccttgacggcgtcctccctggtgtacatggtgctcttcgcgctccacccgtattcgacgagcctcttagggacctccagcccctggaacaccgtcatgaccgcatccgtggaatacgattccttcttgaggaaatccacacagtactctatgagtctgggtatgtcctcttccctcaccgcgaaggacacggccgaagaacagcagttggtcgtcttcgtaggcgtcttggggttgagctggatgatcttgtgttccaggaagtgcccgacgggggcgttctgccccatcttgagggcggtggcccaggtggcccccttctcctttgtatcggtgtcgtccacccctatgaccagcctgaccatcttgggggttatgatgtcgacgtgggccgcgtggccgccgccgatcttgaaatcgtccggatactcggtacggatgacgtccgggcactgcggcaggcatgcccctatgccgacggaggcccctgctataccgtaccaggtggtacggacctcgtcaccctcgaccttgaaggccttcagtccctgaccgcctaggtccgcggacacgggtccgaacctgagttccttctctccgatggacacatccatgacgagggtagtgccctgcatcacgatgttgtcgatgacgccgccggtcctgcggcggttgactatatcccactctccgggcccgcgggcacagcactgctcgattatcttcgccttaccggccttctcgtctacgatcgttatgaaccctctgcagaacaggggaccgtatttcgttttgacctcgtcaggccttagaacggttaccatcggtatgagtctcctttgtcttctggctcttcggccagggataaacattcgggcgggaccctgtcgcacaggtagacggaccttgccgccttacctatcgggaatcccgcatccgcacatctcttcgtgtcgatgtcgaggaccgccacgtcgtccatgcggacggagccggcccttacggcatccctgtatgttccggacaggtgcaccatggccctgtccaccggcatgatgccggtctccatgattatctcctccgcatcgggggagactggatagtaaaggtggtccggcacgtcgtccgtagggaggtgcaggtccaatttcacggtatgtccgtaggtcgccctgaccttatggcccaccacctggtatcttcccttcgggtcggtaagcgccagcgcctctatgtgatggggacgcaaccatttcatgcggggattgatgccgcgcaccgtatccacgatatcgcgcatgtccacaaacccctggggactcatctccaggtcgaacttcccatgcctgaggatggccgcaagggtcctccccatcttctcgacctcgtaatcgctcatcacgaacttccctttctccccgcagacagggcagaaatcgtcgcggtagtatccatgctcctcgcattcgtttatcatatcccagccctcctttcggctgcggagacggcgttggccatgagcatgcatatggtcatgggtccgacgcctccgggcacgggggtgatcatggaggccttctccttcaccgtctcgaaatccacgtccccgaccaatctggaaccgttcttggcggatgggtccgccaccctgttggtcccgacgtctacgacgaccgcgccgtccttcaccatgtcggcggtgacgaatcccgccttgcctatggccacaatcagtatgtccgcctgcctggttatgtccgccagaccttcagtcctggaatgcaccacggtgaccgtggaatccgcaccggggcctttctgcatcatcatggccgccatgggctttccgacgatgttgctcctgcctacgaccaccacgtgctttccgcggatgtcgacgccgctgcggacaagcatctgctgcacccctgcaggcgtggccggaaggaactccggttcgccgatgagcatctttcccacgttgtacgggtggaagcagtccacatccttggagggatccaccgcattgatgaccgccttctcgtctatatgggcggggaggggcagctggatcaggaacccgtgtatggacggatccgcgttaagctccgcgaccttcgccagaagagcatcctgggtcgtactctccggcatgactatcgtgacggagtgcatcccgagctcctcgcatttcctgcccttcatcctgacatagacctgcgacgcagggtcctctccgacgagtaccacggctaaccctgggactatgcccttggacctgagcgattcgatcctctgtctcagttccccgtagatctgctcggacacatctttgccaagaatcaatttggcggtcatgttctcccgtcgattatgacaccgccttatattataattacccgtgggcgcgtcagacggccagacgggatatctcggacagggtggccggcctgttgcctgcctccaggatcccgcggagggccccttccgtcttctccagattttcccggagatcgtcttccgagaacacccctccggaacgggattcgacaatgtgccaggtgtgatctgcaatgaccaggaccccatcctcggggaccgcggatgcaaggtcgatgtagtcttgcggagaccttttcccctcgtgcatgggccacagataggcggatatcctcctgccttcggcatccgttccttccgtgaccggtatctcggcaacatatccgggaagaagcgatggtctgcaatcgtccccgtacgcatactgtgaggaatctatgtggatcccgcaccccacctccttgaggaaatcgcctacggcgcggggttgcctcatatacggggcacggaacgccaccggattcctcccagtgacgtccctgacggcctgacacccgtgcctcaccgcctcgatcgcatcggggcgcgtcatatgccccagagactcatggtcgtatccatgcacacctatctcgaaatgtgccagacatccggatgagtccctggtctcctccaacgtgcggccttcgcagaagaatgcggccggaatagccagatcatccagcatatcggctaggagtgccagacccttggctgaggacgagaaccgcggtgcggtcccatccccgcggtccaaggaccccgcctcgacctgtcccggaacctcgatgttcacgtccctgtccagatccaccgtgaagcagaacagtaccgtcgtatcacctgggctggggcgccgtgaccctctttatgagcataccctctatggccaccggctgataacggtcggccaattcctttgcgcgggccagcttggcctcgttgtcggcgaagagctggaacaatacgtccccagcctccaccctctgtcctttcttcttaagaaggagcattccggcacctttgtcgttgggtgctccgagggccttcgctatcgaaacgatatccttgttgttgatggaatgcacatacccagacttcgaggagacgacgtccgccgtgaacttcccgggtttgaggtcgtcggccttcaggtcgggacttccgccctgggcgaccactatctccatgaatttcctgtgtgccgcaccggacctcaggagttcgcgtgccttctccgtcccgttctggaatccgcccatctccaggattatgccggcacactcgcaggccttctctatgacgctcgcagggtgttcgttcccttccaatatgcggatgcattccctcgcctccagattgggccctatggcgctccccaccggctgatcggcataggttatggcacactctatgtggatacccagcttctctccgaggtccatgaaatctctggcatatgcccgggcgacctctatcgtcgggaccttcgtcccggatcccgtagggatgtccaccaacagatagttggcgcctatggcgagtttcttgctgagtatggacgccagcatctgcgccctcggatttattccgagaggatgttcgatcttgatcacgatatcgtccacaggggcaatgttcatcgatccgccccagacgaaggcgccgccgaccgtctcccctatctccttgagcttctcggccgtcacttcgataccgcagaacgtctccacgaaatcggatgtgccacatgcactgctgatggcgcgggatgacgtcttgggaagcatcagtcccgccgcggcgacgatggataccactatgggggtgatcttgttgccgggcacaccccccatgctgtggaagtcgaatacaggggacctgtcgaaggggatcacatcgccggtgtcgaccatcgcccttgcgaaggcggcgatctcgtcgatgttcatcccgtttatgtaaagggccgtgagccaggacgacacctctatgttggacaggctgccgagatagatgtcgttgacaactccctggatctccttgtcggtaaggacctcgccatccatcttctttctgatggagcggacgctctcgggactgggtgagaataccacgtcgacctcgtccccgtccttcaccttgagccttttggccaccgagttggggaccaggacctcccccacgttgacgaacgcatcggatgtgaggaggaggaccgacatctccgccttcccgttggatacacggacgcggtcgttctccttgacacctatctcggcacaatccgcaggatccatccccacggcgggggaggatgccatcacatcgacgttcttcaccttcagcttcatttggatccccacctctcgagagcctcgcggagctctttgtgggtcttcgcatactcgtccagggctatgccctcgaaggcggcgtcggcagcctggcacatcgccatggccccgcccctcacgccttccggatgtcctgcgacacctcctcccgcctgtatctgcacatcgtttccggtcaccttcatgacggccgggacgatgccagggtacatgcctccggagcacacgggcatgacggtcttgaacgggacattcgtatcacggcaggcctcgaggctcatccttcctcctgccacgtccccttccatcttccccacaccgagggtccctatatgcaaggcgtcccctccacacatacgtaccagcttggagaacacgcacatcgcgataccgttgtacggatccttcgtgatggccgcatgcattgtcctgtggacatgcaccggcactttgatcctggggtcttcggccacggcctgaagggcaccgaatccgctggtcaggacgtccaccatgagttccctcgcaccccagctctgcacatcctccgccagctggacgatgtcgttggcgttgctgctgatgttgatggcgtgcatcatgtgcccgccctcctcgtccaccctgtcgagggcctcggccacggccttggtcctctcctctatcgggcagaacgtctggtcgacgagggtctcgtcatccttgccgttggtaagtcctccgatacctgcctcgtagatgtattccgccgtatccttgggggagagtccgaccttgggcttcacgatggtcccgaccagcggcttctccggacgtgagagcatattcctcatgccctcgtcgccgaatttgggacccttgtactgtctgaggaacgaatcggggaagaagacgtcctccaacctcacccctttcacggatccgagcccgaacaggttcccggctatgaccgagagtatctgcgggacccctccgtatctgccggagaaatcctccacggggaatgcgagggtcaccatgtcgccgtctatcgaggtcaccttgcccgcatacctgtcgaatacatcgtccttcagagtggatatccccgtccacgtcccggtggactgttccgcggcgatggcctccgccgccttctccatggggaggtcggtggtcacacggtatttcgcgaccacgtaggcctccctgtcgatctcctcacccagagccaaatacgaatacgaactcatttcctgtacctcctcacatatatcccgatatacggtcacccaactgtcttaccatcacaccgtagacggagccgggagacattatcccgagttccgtgatgatgttgtctatgtacttggccggcgtcgtgtcgaagaccgggttgaacaccttcaccccttcaggcatctcaccgggcctgattatctcgccgatatccctctcctctatggtcaccgagtccccgaaaagcgtcttcggggagaatttgtatgtctcgctgcagacgttgaactcggcacgtgcctccgaggccgccaatgccacctgggatgtgccgatcttgtttatcagggaaccggacgacgttatggtgtcggccccgacgaagacgcggtccaccttggacatcaccgtacggacggcgctgtcgattatcagggtgacatccaccccggccgcactcagatcccttatggtaaggataccctgtctccaaggacgtgattcggtggcatagaccttgacgtccttcccctgtctcaccgcctccgtgatcacccctatggcggcactgctgttgcaatgggtcatgaggacgtctccgtccttgatcctcttagcaccgatcttggcgatggtctccaccgccttctccgatgattcgacgaaggccgccccgttcctcacgaccgactccctcgcctcttcgaaggacccggcggagtccacgtccctcgtggcggaatggaccccgttccacagggagacggccgtgggtctggaggccaggagtatgtcggaggctttcgccatatccgccctgaacctctcgagatcgttcccgccgtactctctggcatactccgcgagggcggaggccccggcacgggctatcctgccggcgccgcggatgcgcatatccctgatctcggttgccgtatcggctatgatgtctttcacatgagggtaatctgcaagcgcattaataagaggtcggagagaaacggcacgaccgcgagggtgcatacatcttatgagtgcatgtaatccaaactgttaatatcggaatcggcgatagacgcaacatggccgagaagaagaagcatctcagaatgagaggggtgaaacaggcatccaaaagactggaggacgacgtgttgggccgttccaaggacatcgccgagaaccccggcatcctgagacctatgtgcgcaggcaactgcaggaaatgcgtcttcgacaaggtattcaaggacatcgacaagataaaccgctacaaggacgacgaccagaccctcatcaaactcgcgtccaagggattcgacgacatggccaaggcgtatgccggcaccatatccctgaacgccgccggcaaggtaccgctcctggccaccgccgtgatcgcaggggagagggtcccctatgccgtaaggggggctgtggccgtgcccctcctcatcggctgtcagcactacgacgaccccaaactgaggctcctctactacaacggcctcatcaagaaggccggcctccacctgtactccttcggggagagcacggtctgctccgacgaccccaacatgccggaggactatctgtacgacacatggtgggagaccccctacaaattcccggacgacgacgtcgattgcggccacaatggctccgtatccctgaacataaaggtcaggtccgccgacatcaccatacacatatgcgaagactgtgccaaggacgtctcctccctcacatacctcgtatcgagactctgtgcggccgacccgctcgacgacttcgaggtcacggtcgagcacaaataccactcggagaacgacagcgggaccgttaaaataacgggcgacgacctgaagcaatacatggtcgggaagatgaccgaccggatgctcattgagaaggtgaagagggagaaactcggggagttggccaagaacggcggtctgaccctgatcatcggggagaagaactacgggtcggatctggactccttcataggggacctcgacggcccggagaacgagaaatcggccttgaccggattcctgcgctccaatccccgcgccgtggtcctgaagaacgggaagaccagcgaggccaccgcatatctctgggacagcgactggaagggcatcatagcggcatacacgtcggactcgttcgcagaacgttatacggaaaaacccagatcgtcattctccatcgtaatagaggaggcacacagggagttcgtctcccaagacgtcgtaaagaacctgcctgtattccagaagcccggaccggtcacaaaactggcggacgacctggccaaggcggcgaaggtcggaggtctgggtatgttgctcgaagccgtatccaaggccactctgagggattccaagtccaaatccctggccgcggcgttcgtcttcgccgtcgaccctgaaggcaaacccgatctcaccctcagcgcagacgacatggatttcgcagacttcctcagaccgttcaccaagaaggtcctggacgccgacggacagacctaccgtgaagagatgaacacccttctcatggcctgcagttccggagaatcggtctgatcagaatacgcggacgtccgccacatagtgcgagaccgagggtgcgaaggatttcacttcacgtatggattcgatctcgaaccgacggtttccgcaggcatcggagaaggcggaaaaagtcatctcctcctgcttccccacagggaatgtatcgtggtagtggatcatacaacctggcttggccatttgcatggctttcggcaggaattccgatgtcctctgcacatatcccatcagtatgcggtcggcgaaggcccgtcccggtatgtccctgttgtctccgaggatgggtatgacgacatctccgacatcgttgagtgctatgttcttcagaagataaccgtaggaatcgggattcttctcgcaggcgaataccttcctcgcccccgagaacttggccagaggcagggtgaaatatccgatcccgcagaacatatccaccacggtttcgccggaacagtccaatccctccatcctcttcctctcgaagagattccccgaagcgaacatcaccttggtcacatcgaagcagtaacttatcccgttctccaccttgacggactccttcggttccccgtaaaggaccttcatgtccggaacacggaactctccagacacccccgatacgtccgccagcaccgccgagacgccgaggacctcggcataggcctccccgatccgcctgccatattggaaaagagaaggtctcagttttacggtgaccacatcccctgcgatctcccatttctccggcaaatgtgccagatcgtaggaggggatgtcgtcgaggatatcctttatccgctccatggggggacgcgactgctcggaatacgccggaccggtgatcatctccaaccccagggcgatggcgtcgccgcacctctcttcctttatggggaccaggcggaacccttctgcacgggttatgcgggccgacgggtcggctatgccatcatcgaatagtctgggtattagctcggaagcgcggtcttccgggactttcgcctcccttacctgcctcatctccccttcctcagatacgccttcagcataccgcttttgacacctttctgggacaggatcggtttgactatgttgctcgggtcgtcgaaatcgatcatacccagggattcttttatgtcaggggtgtcgaagatctctccgaccgaactcatctgctcgtcattcagcttgagatagaaatctctcatcctggcacctctggagatctccttgccgatgaccctcttccaccctctctcataaagtgccagtacggaggagttgaatacccccagctggtatgcgctgttcaccgtgtcgcacaggacgggtgccgctttgaaaatagggtagaggcctcctccggacactggctttatctgtccggcggcgtcccctatcaaaagggtacggttcgcataggtcgtacgtctgccgccgatggggatctttccgctgaacttctggatgacctccatgccttcgagaccggatatgctgatcagtttcttcagataatccaccggacggaagggaggggagacgcagacccctacgcgtgttacatcccccatagggagctgccacgagaagaaaccgggcgctatgtcatgacccagacgcagtatcatcctgtcctggtcgtccatcctgaatctgatgtcggcctgcatccctacgacgatctcgcggggaaggtcatgacccacatacgtagccaccttggacgagggtccgtccgcaccgactatgatgtcagaccgtacggtcccggcattggtgtccgcgacggcgtatttggtatcggtggtgacgcgattgcactttacgccgtatctgaaatccaccccgaactcgcaagccttatcggccagcttctggtcgagatccacacggtccacggcatatatcataggcgtacggcggcctatgtccaaaaccctcccgtcgggaaaaacaacgtcggcggaggttatggtccccaggatgtccggctggacacctgagagacggatcgtctctggagtgagcataccggcgcagtgcataggcactccgacctgcttatgctcctccagaacgacgacgtccagacctgaagcagccagaagcctcgaggacagggaacctgccggccctccgcctacgacggtgacgtctggcatttagccgatccccgctcactgaccaggcccgttgaccttctcgtaatccgctttgaatttagcgataccttcctcggtcttcgggtgggccaccattttcttgaggatgtcgtagggaatggttgcgatgtcgcatcccatctcggccgcgtcgagcacatgggtagggtgcctgatgctggctgcgatgatctcggtatcgaaaccatactggtggatgatctggacggtctcggagagcatgtcgacaccgtgggtgccgatgtcgtccagcctccctatgaagggggagacgaaccttgctccggccttggctgccatgagggcctgcagagggtcgaagataagggtcatgttgactgcgataccctcggaggagagggccttggtagccttcagggactcgatgcacatggggagtttgacattgacattgggtgcgatagcggccagtttctttccctcggctatcattccgtccgcatcgagagccatgacctctgcggatacggggcggtctccgaggatcttggcgatctccttgacgcgggtgggggtgtcggtgttctccttggctacgagactggggttggtggtgactccgtcgaggatcccccagctgttgatctccttgatcatgtcgagatttgcagtgtctatgaatatcttcatcttatcatctcttcttgttgatagcgttcttggccgcagccaccaggtcggaggctgtaagaccgtatttcttgagcagttcgtccgcatccccggattcaccgaacgtgtcacgggtcccgaccctgacgaggggcgtcggaagattctcggagaggaattccgctaccgcggaacccagacctcctatgatgctgtgctcctccacggtgactaccgcaccggtcttggatgcggtggcctttaccgcctcctcgtcgagaggtttgatggtggacatgttgaccacctcggcgcttatcccttccgaggcgagtgtctccgccgcctcgagggccgcaccgaccatctgcccgcaggctatgatcgaaacgtcatcgccttccctcatgacggtggccttcccgatctggaacttgcaatcctgggacatgatgacggggaactcggaacgacccatcctcatgtatgccggacctttcatctcggccagcgccatggtggcggcataggcctcataggcgtcgcagggaacgacgacggtcatgttgggaagcgacctcattacggagatgtcctccaacgcctgatgggtggccccgtcgggacctacggacagtccgcagtgggtggcaacgatcttgacgttcagcttgggataggccactgccatcctgatctgctcccaacaccttccgctggcgaacactccgaaggtggaggcgaatgcggtcttgccggatacggcgaggcctgcggccaccccgatcatgttggcttccgcgataccgacctcgacgaacctctcgggggcgaccttcttgaaattgcctgtcttggtggatcctgcaaggtcggcatccaggacgacgacgttcttgtccttctccgccagatcggccagtgccttcccgtagtacgagcgctgtgcgagtttctcgcctgtcactgtatcaccgccttgagctcctctaccgccttcgcatactcgtcgggcttgcaagaccttccatggaagtccacgttgttctccatgaaggatacgcccttccctttgatggtgttcatgatgatcaccgtgggattcttcttggacctcgccgccttgtcgcaggcgtcgatgatctgacggatgttgtggccatcgattatgatgacgttccatccaaaggctctgaacttctccggcagagggtcgagcgacatgacctcctccgtgttcccgcagatctgcagacggttgcggtccacgaaacctatcaggttgttgaggccgtacctgtgggcgaacatcgccgcctcccagttctgcccctcctgcagctccccgtcccccatgagacagtagacgcggtagtccttggaatccatctttccggccaatgccattccgcaggccatgctgagaccctgtccgagggatccggtcgtgacctcgacgccgggcacctcgcggtaggcgggatgtccctgcaaccgggaaccgagctgcctgagggtcttgagttcgtccgtagggaaatatcccctttctgcgagtgtcgcatataggatcggggccgcatgccccttggaaagtacgaacctgtccctgtcctccatgtatgggtcggcagggtcgatgttcatgatgcggaagtagagggttgccagaaggtccgctgaggaaagggaccctccggggtgcccggaccctgccgcggtcgtcatctccacgacatcgagtctgagtctgttcgcgatgttctggatctcgccgacgcttatgtcgctcatctcttacgcctcagtcgctctcgatcctgggcgccaggaagtagacgacgtccgccttgccttcagccaacgcaaacaggatcttcacaggatagtcattatccaactggatgtccacgacggttcccgcagggatcacctttacgatgttggagaagtaatcgagggggtagaggctgctgaccttaccctcggatttcagaccttccaggtcggatgccgggagtctgaggcttgcaaggtcggtgtccccttcgcaggccagctcgaatccctccggatccgcctcgagagagatgtggtcggagatggactccgccgcgctgatccctttcttgaggtggtcgatcttcaccttgacgtcggtggcgagttcgatctgggggaccttggggtcgttcatgctgctggtgtccaccaggctcatgcgcctggttatgttaccgatcctgaaggtgagccttccctggtcggggtcgtgctccaggattatgctgtccccgggacctgccagtttgagaacggacttcaccttgtcgaggtcgagcccgatctcggtctcgtcggcagagtagttctcgaaagcatccttgctcacggttatgtcgagcatggcgacatgtgccggatcgattgccttcagggaaagcgagtccgggtgtatcgtgaatttcacttcgtctaccaacgtcgaaacgatgtagacaatacccttcagggtatccgattttatctctgccttgaacatcctatctctctccagtccagaggtcagttctgtctccaggtatggttgcacttgcagcaacggtagaacatggtctcaggctcatccgcggcgcgggtctgcctgatgacatagtatgcttccgtatgtccacactcagggcacgtgatgcgggtcttcggaagagtagcatcgttctcggagatgatggtcatctccttgttctgagaatcggtcttgtagacctgcgcctttccgcttacatcctcttcatggccgcagctagcgcacttgtactttccgtctttcgggaacatcattgagccgcattcagggcaaaacaaacttatcagcctctgttatttaatgcggacaaccgattacgctattaatatttttagcggaaataatgaaaggaattatggacggtcggaagcggggctttgggggatcctgcattccttgcccttgcctacccgaccgtcacgatcgaaaatggcctcgaacggactgcgtctgccgtctctgcggactgtctgctgtgccacggtgtccgtcgtggaatcctgtatggatgaactggatgatgaccccccgtccgacatatgaaaacacctcctggcacaatggtttgtcccgggggatgtcccccgggagcattcatcagcgcttggtggacttgcgcttcttcttcatcgccctggtgttctccttgacggccttgacgatgacctcggcctccgccacaccgtcggttatgtcggcctcggagaagtggaggacggtccagccttccttggcgagggtctcgtccttggatgtcatggggacttctccgtccacgaacacggcgacctttcccttgacgaaggccacggggatcttgtacttgccgtaatccctcctgcagcggagtcccttgttccatgcggccctcctgacgaaggtctcaggggtgtcgggctcaagacccagatcctcgagagacagcatgtagtcgtcgtctccggaatcgatttcggaggagtcttcctcggggatgttctctccctcgtcttcgtcgacggcgactgccgcacctgcgacagcaggctgctcggcaggggcttcctcgaccggtgcgggctcggcgggcttctcctcttctgcgggggtctcctccgccggagcgggctgctcggaaagcctttcttcgttctctgccttgacggccgctgcttctgcggctgcatcctgggaactcatgaccttaggcatctcgggaatctcttcctctgcgggggtttcctcgacaggcgcaggctctgcaggagtttcctcgacaggcgcaggctctgcaggagtttcctcgacgactgctgcgggtgcgggctcggcgggcttctcctcctcggcaggggtgactgcggcaggagcttcctcgaccgctgccgcaggtgcgggctcggcgggcttctcctctgcaggggtctcctcgacaggcgcaggctcggcgggcttctcctcctctgtgacaactgcgggagtctcctccttcggctcctcggactcctctgcaggggtctcctcggactccttggcagctgcagcggcggccgcggcgaccttggcctccctgatggcgtacaggaccacgaacagtccgatgaagaacaggaggatcgctccgacgacaggcatgaacatgtcggatgcgaaacaatagagcgggaacccgtgtccgaggatctcgacgatcttgccatcgaaatcccttcccttaagcacgacaatgaggaagaagaggattatgaacacgatgatgcccacatatctcttccttgatgcggtgaatgcgatggccacgatggcggttatagcgaagaggaccgtcaggaacagatcgacgttgctctccacccactggatctcccctgcggcggccatgaggaagacggcaccgataagggctacgagggctccgaggacacagttgaaagtagagcgggatttggaccccgtgacaatggatccgagccctcctacaatggcgactcctcctgccacctcggtgagaagtttgcatgtgtcgttagcgaagaaatcattcaacgaaatcgctgcaatagccatgtcgtcaaactttgccagtatgacggcgataatgaaaatgacggcggcaatcatctcgatgatgccgaacgctttagtccaaccattcatacccagataactgtttttaaagatatatactcattgtcccccgccctatatgatgtaaagagacgttttttccaaacatgacatgctgtgaaaacgtgtcctacacatctgggtcattatgacaacatacatacatcgaaagacattctaacaatctggcactgctgtaatgcacgatatcgatgtccgaccgccgacgtccctgcggaggtactccggaaaacgccttttttaaaagattaatataataagagcgtctaatgcaagaacattaacggcagccacgggctagtcgcacatattacagtccagaagtcatccggcttctatcacaggccctcgagagaggcaagaaaaggagagtaagaccaatgaaaatgaaattcaacttcttaggcggtgccgacatggtcggacgcatggcaatgaccatggaaggtgacggaaaaaccatgcttatggagtacggggtcagtccgaccaaacctccggagtaccctcttcccgttcccggaaagatcgaccacatgttcctcacccacagccacctcgaccactgtggcatggtgcctgcggtgtgcggaaaacagaactgcgagctgttcaccacacccctgagtgcggagatctccgagctcatgatgtatgacagcctgaagatcgccaaggccgagggataccccattccatatacccagcaggatatcgagaggaccatgaagcacgtggtgcccctggcgttcgaagacaccatcgagttgggaaacatcgacgtcaccctccactcggcaggacatgttcccggagcatcgatgttcgagttcaaagccgacagcagcaccctgtacaccggcgacatccacactgaggaccagaagctagtcctcggggcgaggtcccgcgattgcaagaacctcttcatagagggaacctacggcggcaggaaccaccctccgaaggaggacaccatcaacgcattcatcgcgaagatcgacgaggtcatcgacaggggaggcatcgtcatcatcccctgcttcgcagtcggaaggacccaggagatcatgctcctgctgaagaacctcggttacgaaatgtgggtggacggaatgggaagatcggtcaccaacctgttcctcgactatcccgagtacatcaggaacgccaagtccctgaaggcggccaagaggacgttcaacgagatcaggaacaacgcgtccaggaagaaggccgtggaaggacagatcatcgtcaccaccggaggaatgctggacggaggacctgtactcacctacctcaggaccctcaaggacaacccgaagaacgccatcctcctcgtagggtaccaggccgaggataccaacggaaggatgctcatggagcagggctgcatcaacctcgacggcgaggtcgtcaaggtggcctgcgaggtgcagaagttcgacttctccgcccatgcgggacacgaccagatcgtccagttcatcagggaatgcgacccggagaacgtcgtcatcatgcactccgagaccagggaactgttcctccccgatctggaagactacaatgtcatcctgccggagcccaacgtcccgttcgagctggacatatgagagcccccgacctgcgcccgttcctcgaggaggatgtcggaagcggcgatctgacgtcgcagatattcctccccgacagggacggcaaagccgtcatcacctgcgaatccgactcgacagtggccgggatcgacgaggcggtgacggtgttttcgatcatgggcgtaaagtgccagaccttcgtagaagacggggacagggtgaagaaagggacggtcgtcatagaagcttccggcccccttagatccctgatgacatgcgaacgtaccgctctgaatttcctcatgaggatgagcgggatcgccgagatgacccgttccatatccgagaagatacacgccttggaccccgacctcagagtcgccggatccaggaagacgacccccggattcaggtatttcgagaagaaggccatagcgctaggcggaggatggcctcaccgtatgggactctatgacatggtcatggtcaaggacaaccacatagcggccgccggcgggatggatgccatagcggcaaagatcaaagatgtgccggaaggggtgcctgtggagatcgaggtattggaccacgatgaaggcataaaggccgcgaagtgcggtgcggacatcgtcatgggggaccacttctccccggaagaggtaaaacgcctcagagaagacctcaggaagatcaatcccgacatattggtggaggcctccggcaacataacccccgagaccgccatagaatatgcgggatgtgcggacatcgtatccctcggagcactgacacattccgtgaaatcgacccatttctcgatggacgtcgagtaaaccactatttacccgttatcctattacggaacatatgctagacttcagccagtacaaatgtgaattctgcggaaagacctgcactcaggtcgtgttcgctgcattcgtctgcgacgacccggaatgcgtggataaagcatacctcgcaagaggaggacccggagggcacatgaagaggaaagcagaaggaaaacccattgtgccagaggtagtctgcgaacctgaaaggaacgcccgttccgaccccaaggacgactgaatatcgatattgaaacaatttggaatacaggggggatgtccccctgttttgatttttttatcagctgtgcctgaagacacggcatccggtgaagaccatcgctatgttggcctcgttggccgcatcgatggactcctggtccctgatgcttcctccgggctgtatgatggcggtgatgcctgcctgggcggctgcatcgacggcgtccctgaacgggaagaatgcgtcagaagccatcacacatccctgggtgggctcgttggccttgaaggaggcgatcttcgcagaatcgacacggctcatctgtcctgcaccgataccgacggcatgctctcccctgacatagaccaccgcattggacatgacgtgctttgccagcttccatgcgaacaggagggagtggatctcttcctccgtcggggcacgcttggtgacgaccttcaggttcttcgggtcgattggcacgtcctcatcggtctggacaaggagtccgccctgggtcctcttggtcttcatctcccttacgcggtactggggccccatgggcatgccggtctcgacgaggcggatgttcttcttgagcttgaggacctcgagcgcaccgagctcgaaatcgggggcgacgacgacctccacgaaatattcgtggatcatcttggcggtctcgacgtcacaggtcctgttgagggcgatgacacagccgaatgccgacagggggtccacatcgtaggcggtcctgaaggccttggcgatcgtatcgtcactggccagcccgcaggggttcgtatgcttcatgacgaccgcggtgggcctctcgaaatccatgacgatgtcgatggccttgtccatgtcgatgatgttgttgtaggaaagttccttcccatggaggatcttggatttggctatcgtcacgcccgtggtgaacggatccgcataatatgcggccttctggttggggttctccccgtatctgaggtcccacatcttctccgtaggctggggccaggaggaggggaacatgtcctttccgaggatggggttcatcttggcggcgatcatcgcatcatagttggcggtgaccgtgaaagcctgggccatgagcctgccgaggatcttctcgtcgagttccccgtccttggcgatcatgttcccgatgaccatctcgtactggttcgggtcggtgacgacggcgacggacttgtagttcttggccgccgcacggatcatggacgggccgccgatgtcgatgttctccacgatgtcgtcgaaggtggcgccctccttgagaacggtctgtttgaaaggatagaggttgacgacgaccatgtctatcggcttgatcttcatctccttgatggccttcatgtgctcgggattgtccctgcgggcgaggagcccggcatggatgttgggatggagggtcttcacacgcccgtccagcatctcggggaatccggtcacgtcggagacctccgccaccttcactccgctgtcgttcaggagcttgtaggtcccgccggtggagattatctccactcccatggaagcgagctgtttcgcgaaatccactatgcctgtcttgtcagaaacgctgatgattgctctcttgatctttaccagttgaatgcccccaaacgattcttgcgtttgtgcaacattgaattcgtatcgttataagatagataaaccaatcgtcaattggtcagatgtgttacgtcggtacagacgtcccggggaggattaatgaatgcggtcgtacatccgctccgcgtgatgaggagaaaggacctcgagatcgctctcgagaaagtgcccagattcgaagacccagatccttccctggaacagtatcccacccctgcggccatagctgcggagatcgtcttcgacgcctacaggagaggggacatagccggcatgaaggtaatggacctcggatgcggcacggggatgttctccatggccgcctggctcatgggtgcgggaatggtcgtgggatacgacatctccgagaaggccctggcctcggcaaggatgtgtgcggaatgtttcggagcggacatcgatttcaaactgtctgacgtaaaggatgtctgcgaaggtgcggacaccgtcctcatgaatccgccgttcggaagccagagacgcaacgccgaccgtccgttcctggacaaggcgatggaatccgccgagagggtctactccatccacatggccaacaccctggacttcctcatgggatatacagaagagaaggggaggcgcatctcttcttataaaatatataagtacgatatcccgcatacattctcattccatacgaagacgaaacaaacggtggagatagccgccgttcttatagaatgacaatttcaggtgaatcatcatgaccgacagacaggttcttccgggcgacgagatcgcagtcgaggaggagtacgtatcctccgacggcacatacgtcagggacgggaagatctacgcatcccaactggggacactcgttctggacgacaacgagagcatcgctaaggtcgtctccccgaatccccccaacatcctgaaggagggggacataatctatgccaccatcgacgatacgaggaagaccatggccacggccacggcactcgtggcagagggcaataggagggccatagccagcagcaccgacgccaccctccatgtatccaagatatcccccgactacaccgacaacgtaggcgacgaggtgagaaagggggacctcatacgcgcccgcgtcataagcaccaagccttcccttcagctcaccaccaaagacgtacacctcggggtcgtccgcgcacaatgcggcatgtgcaagaccgaactggagaggaaagggaagaacctgtactgccccaagtgcaggcgttcgcaacccaggaagctggcggacgactacggggacgtgaagatatgacggagccggaggaaagggaactcaaagacctccgtatggaggtcaagaacctgaaaagcgaggtgaaggagttgcgcgagttcatcaaggcactctacgctatgctcaacgaggacgaggaataccagtcatccgacgatttcctcggcggcatcgaatacggaaggaccaacacatgaaggccgtatgtctcatgtctggcgggatcgactcgccggtggccgcgtacgtcatgtcgaaggtgggggccgacatcatcctcctccacatggacaaccgtccgtatgccgacgaccgccctatcgaacgcgccaagatgctggcggcacgcataagggaggagaccggaaaggacatcccgctctatgtcgcacctcacggcgcatcccagaaggccatagcggacaatgcggacagtctttatcagtgcgtcctctgcaaacacgcaatgcagcttacggccaagaaactgtgccagaagctcggggccagtgcgatagtcatgggggattccctgggacaggtcgcatcgcagaccctcctcaacatacgttccgaggtgaagggagtggatttcaccatcctccgtccgctcatagggtatgacaagcaggagatcatagagatcgcccagaagatagggactttcgagatatccaacatgcccgccaccgggtgcaccgcacttcccaaaaaggtggtcaccgaagcagacatcgaaaagacccagaagttctacgaagcctgcgatatagagaaactggcggagatctgcgcagacaatgcggtaatggtcgactgaggatattcagtaatccctggacctcttcttttccgtatagctgtagaatgcaggacaggaatcgatctcgtcctcgtcgtagatcatatccatcgtcaccctctcgaggtacggagcctgcacgcgggatatgtagaggacgttgtctccgatctgtatctgggtatccgatggcttaggctgtttgacggtcgtagggacgagggcgggacccatacacgcagtacagacacggtagtcctgtttctcgcgcatgatcatctgctttacatcctcgtctacggctattgccatgctccgccttatccaagcattcctatttaatgggattggaagaatctgcgtacctctgcaacaggatccgaggtcagcttcgcatccagaccgtccagcgaggccacccttctatccaggatcaccgccatcccgcggtccccctcggacctgatcagtctgccgatcgcctgtctcatcttcctgaccgccggcaccctcacagccatgtcccagccgttgccgaaacggttctgacagtaccctatgagcgcatcctgcttggcggagggatgggcgaaaggtatcccgactatgacggccagctccagctgcctaccggggaaatccaagccctcgctgaccctgcctcctgtgacggcgaagagcacggagccctccttcccgaggaaatccgatatctgttccatcaactccgactgcggcatacccctccgctcgaagtaaacctctctcccgagagcgtctggcactttatcctccacgaacctttccatgactccgtatgaggggaagaacaccgcggtactgcgatccgatgccccgactatgtccaccacgtatctcttcagacggtcgtatgtcccgtcgtcgctgtttatctcggagaacttcgtggatacgtcgttgacgtagaagacttccagattctccttcgggaacggggaaggaaagacctccgataccggatcctccagacccatctcgcctgcataatccttcaacggagacaaagtgccagacatgctcactgaagacagacatgtactgagaggctcggcggcctccccgggatcgagacagtatgcctccagataggggttgtctccccccgataccaggaatacgtgcgaatagctgtcgaacgacatccatgcacatatgaacccggccagggaagacaggtgggaacgtgggagtttgcgtttggccttcttcgattcctctatggagatgccgacctcggccagcctcatgaccaggtcgcgtaccccggcagaggtcatacccagacggaccatcatctcctcacccagatagtcgggcgggatcatgtcgctctcgcgtctcagatactccttctgagcgtctgccattatgtccctcatgagctggacgatatctttgcaggaaatgtcctggacaagcaacggattaccgttcctgtcggcctcggaatccgccagatccaacgaacgggccgtacagcggcatgtcatactgtcgcgcaggtatgacgggagattgtgcgcctcgtccacgatgacgacgacctcgcggtcggagacgcccatccattggaggaaatggttctttatggcagggatgaagaagaacgcatagggcgcactcaccacattggcgtatgggagaagcttcttgacggtctcgtacggacatatccccctggccgcacagaagtcccggaattcctcgggatccggatgtctggcacgtatgaatgatatgcacgcctcgacctcggtgctgcctatgttctcgaagtaggagcatttcccggccggaccagtgcctttcttaagttcggcacatagtttggaaagctcttccgaagtcccgtccgacagatcgcggtcggacagcatcatagggcaggtggctggaccgcgtccctgtacggctatacagatcacatcggtacgggcccctatggccctggcctcgacggccacctgcttctgctgggactttgtgcgcgtaaggaaaacgaccttgcgcgcagtcccggatataccctcgagggccccggccagggagacggatgtcttccccgtaccggtgcctgattcgaggaccacacatctcccgcccctcacggaatccctgatgagacggattatgccgtcctgaccgggtctgaggggatacgggaagaggtcattcatcggactttttcctgcaggcccacatatcgtcggtgacttcggtcttatagatcgattcggaatcgtcgatgaccttggcggccctgggtttcttctccatgaggcggtttatcctccccctgttgaagagccagtaatggatcctccattcacggccgtcgtaaagggtgatctcctccctctcggtgaacaggatgcctgcatcctccatcatgtagaacgcatcgcggtcctcgggctcgaggacgttgtcaatgatcctctcggagtacccgaagaagttgaggacgtgctgggcgaggtcgtatgcctcctcctgggacagaccgttgccgtcgtcgatactgttctcgatggcgagtgtcaggttgtctacggtgatcatggtcgcaccgccgtcagttgtccgcgagctctacgaacttcgcctctccgttgacggccttggcgatctcgtcgactatcttctgatccacggtcttgccgacgaggaggaccatcatggccttgtcggaacccttcttcgtggagacggccatctgctggatgtcgacccctgcggcaccgaggacgctgccgaccttgccgacgataccggtggtgtccttgtaggtcacgaacagcatgtctcccgcgagggggacgttgaatgcgtaaccgttgtagttgacgagcctgggctcctctccgaagacggtaccgcggatgcaggaggccttcccggcggacatgatcttgacctctatcaggttggagtagctggtggccttgtcggtcttcgactccttgacgtcgatgcctttggatttggcgacggggagggcgttgatgatgttggcgccgtcgaccccgacgataccctttatgagtcccttcacggccgatacggtgaggatcttgctgtccatggtcgacagaccgccgtagtagaccacctccatctcctcgatgggctggttccctacggtctggtggatgaactcgcccatgctctccgcgagaggcacgtagggggccgtctccggggtgagctttccgcggggtgcgttaatggcgttggtgattattccgtccctgaggtacttgacggcggagttggcgatatcgacggccaccctctcctgggcctcgacggtactggccccgaggtgcggggtggtgaccaggttgtccagctcgaggagcttcttctcggcgtccgtcaggggctcgttgcaccatacgtcgaaggcggcacctgcgatgatgtggtcgtggagggcggtgtagaggtcgtcctcgttgactatgcctccgcgggccacgttggcgagccttgcgttgggcttcatcatcttgaactgttccagcgagatcatgttgcgggtcgagggcagaagcggggtgtggatggtcatgaagtccgcggtggtgatgacctcctcgagggtggtcagcctgacccctatctcgtctgcgacctccttcggcaggaaggggtcgtaccccaccatggtcatgttgaagggcttgagcctcttggcgacctcgcctcccacacggcctacgccgatgataccgaggaccttcccgttcagctcgaccccggtgaacttggacctgtcccatttgccctcgtgcatggacgagtgggcgaacgggatgttcctggccagggaaaggatcatggcgcaggtgtgctctgccgcggacaggatgttcgcggtgggggtgttcatgatgaggatacccttctcggtggcataggggatgtcgacgttgtccacaccgacccctgcacgtccgatgacgcgaagcttcttggccgcgtcgatgaccttcctggtcaccttggtgccggaccttatgatgagtgcgtcgtagtcgacgatctccttgcagagttcgtcctcggtcattccgggcttcatgaccaccgggatgccggaggcctcgaggatgtcgagaccgtctttgctgagtttatcggaaacaagaatctttgccatttactgcttcatctcctcgagggcttcgtccatgacggacaggagctgtttgatgtcgtccttcgtgaggtcgcccatgtggccgatcctgaaggtgctcttcttgatgtcaccgtatccgttggagatctccatccccttggacttgatgatcgaatggaacttgtcgaagtcgaggtcgcccctcttgatgaccccgatggtgttggaacggtagccttcctccgggaagaccccctgcatcctctcgtcggcccatttgcggaccatgtcggccatctcctgatgccttctgtaacgggtggccatcccctccttcagcatcttgtcgagctggtagtcgacaccgtacatgagggacacgggaggggtcgtgagggcgtagttctcatcgttcttctccttgagtttgacgtaatcggtatagaaccccttgttctccatcttctcggacttcttcatgagttcgggggagaccacgacgaatgcgagtccgggaggcagggcgagggccttctgggttccgaacacgacggagtcgggctgcacgtccttgaacttcagatccatggcgaacatggaggtgacggcatcgatcatgacgagggagtcggggttctggtccctgacctccttggcgagggcgacggaatcgcaatacactcccgtggaggactcgttgctgacccagtggacggcctcgatgtccttggtgacctttccggcgatgtcggcgggtttgacggccttccccatagggaccttgacgacgtcgacctgcttcccgttggaggtggcgacctcgatggacctgtctccgaaagaaccggacgtcaatccgagggagtgcttcgcgatcgcattcctcgcggacccttccaggagcacggtggcggatcccgccaccatgaaaatgtcgttgtcggtgccgagggtcttgtggagcttctcctcgatatcggcatggagctgtttgtactccttcgacctgtgggtgatcatgggcctgtccattgccttaagcgtgtcgtccgccacattcacggggccgacggtgaataatttcctgctcatttggatccctgagtgtccttaattggacgtaacgagcacgactatcatccatcctttatttttatgtttgcgattgaaacgcgtacgcgtaggcgcgttatagaaaagtatggatgggaatggagaaggaacgggtttgataggggccggcggacctgctcagaggtccgccatgaacttcttgatcctgctgaacccttcgcggatctggtcctcgctggtggcgtaggagatcctgaagaatccctccccgtggggaccgaaggccgctccgggggtgatggccacgtgggcgtcggtcagcatcttcttcgcaagatccaccgaatggatgttggcgtcgtacttcgggaagagatagaatgcgccctcgggcttctggcactctatgcctttgatctccgtcaggaggtcgtaggccaggtcgcgcctcttcttgaactgtgccaccatgtcgtgcatcggctcctgggtccccttgagcgcctcgaccgcaccctcctgggcgaaggacacgcagcaggagatggagtggctctgcagcttgttgatgttcttgatgttgtcgacggagctgatggcccatccgatcctccatccggtcatggcataggtcttggaaagaccggatacggtgatggtcctgtcgatcatgccgggcatggatgccacggagaagtgctttccggaatagatcacgtgctcgtatatctcgtcggcgagtatgaggaggtcgtgtttcacggcgatctccgcgatggccctgatggtgtcctcggggagcacgcacccggtcggattggcgggggtgttgaggatgatcatcttggtcttgggggtgacagcggcctccaccttctcgggactgagtatgaaaccgtcgtcgtaggaaaggggcacatagacgggtttcgctccgcacagctttatgacggcctcgtaggtgacccatccggggtcggggaggatgacctcgtccccgggatccagatatgtcagggcggtcatgaatatggcctgcttgcaaggggtgacaagcacgttcatggaggacacgttgatgccgttgtccctcctgacggtgttggcgatcgcctccttgagctccgggatcccggtgctgggtgtgtaatgggtgaatccgctgtcgagagattccttcgccgcttctatgatgttggacggggtgacgaagtccggttcccccatggagaacgagacgatgtctatgccttgtgccttcagatcgctgaccagattagagatggcgatggtcccggatgccgggatctcctggattctcttcgaaacgtaaaccatattggcccctcttttcccgaggattaaagaggggcattatataagttacgaaaaccaaggactattggaccgtacatatgtccgacataaggccgggatcgcaaaggccgtttgtacaaacgtctaccggccgccgctgaaaacgaacgtttcgcggacagggggaagggaaagacccctccctcgggaaatgtcccagatgtcggaaggtcaggatatcagggtcttgagctttccgacctggaccgcgtcgcggatctccatggccatcctggcccccgtgctcatgccggggtagatcatctcggcgtacggggaaccgttgatgaacgggttggtcccggcgacgatcctggtggagatctcgaagatcctgaactccagcttgtcgttgaccacggtctcgagacagaacggcccccacatgccgccgaacagctcgtaggagcggttgactatattctccgccatctcgaacgccttgggaaggagcgactccctgatgacgacgggggtgttcccggtcacgacaaaggacgggtagaggccatgcctcttggcgtcctcgatgctgccgagcttgtacatctcgtcgatgttggactcgtcgcgcctgtctatggacagaagttccagggatccgccctgctttatcctgtatccgtccgtcttgagagggtcgtagaagaagtggaggtagtacctggttccgaggcagtactcctgtatggtgtagggctggctgttgtctatccccatcttgaagtccggatagtccttcgcgatgaagaacccgcggccccctttggccccatggtacttcaccatgactggctcttttatctcgcgggcatccgtgatgaggcggggcatgggggctccggcggaggtgatccacgacctctgcttgtccctgtcggactcccagttcaacacggcacggttcccgtacgaaggcacggcgaagtcctcgaatttcttggcccccatgtactcgacgaacgacccgtgggggatgaggacgacgttctcgtccaaaagctccccggcgcgctcctccatatcgtcgtagtcggagtagctgatgaacctgtcgggcttggcgagagggaacgcatcgtagattttctgattgttcttggtgacgagcccgagggtcttgaaccccatcttgcgggcaccgtggaagatctgcagggacgagtgggaacagagggtcgcaatagtgagcttgctcggatcgtaaccgtccagaatctcatcgatcttcttctttggaaccatattcgcttattggtttcctctttttaaatatagtggtcccgggagtgggaatattttaggcatgaacacgattcatgctctgtgctggactgctacttcttggacatatcgccgcttctcaacggcgggatactggtcaactcgctgaccgtcctgccgaaggacaggaccatgaacgtcctgtcgtacggcagtcccggggaccgtgcccgctccgcagggtccggcatgctcatcgaatacgtccgtaacgagtacggtgtcaagggaaggctcaaggtggaccgcttcgggaagccgtccttctcaggaggactcccgttcagcatagcccgttccgggtcttacaccataatcgccgtatcggacgagcccgtcggagtggatctggcaagggcatcctcgctcgacgccgggacgttccccttcatgttcaccggggaagagctgtccatcataaacggcagcggcagatggaggagggtggcggcctgccgcatgtggactggtaaggagagctacctgaaggccctcggcaagaacctctcgctcgacccggggtcgttcgagatcgccaaaccccatcgcagcgggttcgtgatggaacgtcccggatggaagatccatgagctcaaggccccgaaaggatactgtgccagcgtgtgtgcgtcccccactgccgggacaccttccgtgaagaacctcttcctgtccgacgacggcatgtccctcttctaaggaacgggtatcggacatacatccgggaccgtatgactgcatgcaatacgagggctcaaatactcacagggcatggtgattttccagcgcgggatgtccttcggaccacgcgaaaaaggcaacaaaccgcctcagagtatactgaaagaagaggcctgaaaaatggataattttgagaacatggacatagagccgatcgtcaaggatctctacgacgcattggacggaaaggtggacgaggcgaccatccgcaaggaggtcgacacctacatcaacacataccgcatccccgtggattccgccaagagcgggatcctcaagaaactggggaacacacgtccggccaacgcattcaccggcggccagaacgtgaccaagaagatcgcggaactcgaaggcaccgagatgaacgtcaccgtcgtcgccaagatggtcttcgtagagaagaggaccatcaacgcgaagggcgtcgagaagaccatcatctccggtatagccggggacgacaccggaacgaccccgttcaccatatggagcgattccggggaatacgagaagggctccgtctacacgttccgcaacgcatatacgaagaaatggcgcgaccaggtccaactcaacatcgggagccgcggaaaggttgaaccgaacaccgaggtcaccttcgacaacgtgtcccgttccgccggttccgccgcacaggagatggacatcggcaacatcaccgaacagaccaagaactgcaccgtcaccgggaaggtgtcggagatcgcatccagggtcatcaacgtcaaaggcgaggagaagaccatatggggcgggatgatggcggattccaccggaaggatccagttcaccgcctggaaggacttcggtctgaaggacggggaggtcatatgcgccaagaacgcctacatccgcgcatggaaaggcatacctcagctcaacctcggggacaacaccgaagtggaacgttccgacaaggacatcggcgagatagcggacggcaccaccgagaagacggtggaggatgtcgtcaggatcggaggaggcctcgacatatcaatcaccgggaccatagtcgatctgaggaccggcagcggcctcatcaggagatgcccgcagtgcaaccgctccgtcctctccgacgaatgtaccatccacggacacatcgaacccgtcatggacctcagactgaaggccaccgttgacgacgggaccggtgccatcagcgccgtcatcggcagggcggagacggagaagatcacaggcatcacactggaacaggcggaggagatctccaagaccaagggtgacatgggtgccgtggccaacaagatggccagcatactgatcctgaagaaggtcaccgtcaaagggaatgtgatgaccgacgacttcggaccgcagatgatcgtccattccgcagacatatccaacgtggacgtgcagtccgaggctgagaaactttacgaagaagtggagggatcgatgtgagcgccggaaccagagagacggcctggagggtattctcctccgagctgaacaccgcatcttacgagatcaaggcagaggcggagaagatgccgtcctaccagctcagcagactgggcgccatgatcaacagggtcctcatagcaggggtcctgacggagaaggagaacgtagggtctcccgaggaacccctgtggaggggaaggatacaggacgtggccagcggcaccgtctacatcaacataggcaggtatcagccggaagcggcggcggccatggtggacatcgaacccccgtgcctcgtcgccgtggtcggaaaggtcaaatcctacaccacggaagaccagaggacatatgtgtcagtacgtccggagaggatcatccccatcgatgagaacacccagagagagtggctcctcgacaccgccagatccacatggaagagactggtcgacatgaagaccgccatggggaccatcgacaagtccgtcgcagggctgaccaaggaaggtttctccgagctgtccgccaaagggataagtctggcactggaacaatacggcatgccggactcggccatgttcctcaaatccatacaggctgccctcaggaccctcctccccgacaagaacgttgatctgggtcttcccgaggacctgtccgagaaccccgaggagatcgatctcgaaccccagtcgtccggggacgattcggaggataaggaggagatcgtgctcgaacttctcacggaactcgacaccgagggcaaaggagcgccccgcgacgacctggagagaagggccgaacaggaagggatatccagcatggagctcgaggagatcaccaacaccctcatggacaaaggcgtcatctacgagcctaacctgagatacctcaaacgtatctgaaaaacacttagcccggtcatctttcatcggatgaccggacacggccatctggcacattctattcaagacttgtacatcacggcggaaccgtacccgaccaccgaattgcggtcgtatcctatggattcgaaggagtccgtccgatccaagacctctatcctgcctccggacagcatcatcgccaccgctatggggccataaccgcagaccgacagcctctccttctccaccagcctgtagaccgaggagacgtctcccgaggcgacggcgtccatgaacatcgaatccatctcgtccgcatacggcttggggacgtaatgcaccaggtcgctggaggctatgatgacgacatcgtggccggaacaggccgccttcacagactgtgccagacgttctgcggaccgcatgctctgccgtcccattattatggggacgatcttggctttcggatctatgtattggatgaaagggacctccacctccacggagtgctcccttgtatgcgcacgcacatcgtccggtatgagctccctcagcctcatcgctatgtcttcatggacctcgcagcgaccgaacggcgtcacgtattcctcgccgcacatgacgctctcgtaaggcacaccgtagtggtcgggaccgatgacgatataggcctccggaagcccgtcctcggctatggatctgaaagaataggcggcacaggtcccggagcacagatagcccgcatgaggcgacaggacggcggaaacggcccttctgccggaacatccgcacggctcccctggaccctccctgaagcactgggatatctgggacctcaatactgtgggatcggacggatagaacgtccctgctacggccggaatgcgcatgaaaaacaataggtgttggaagtaataggttttatcgatgataccgagggtgcccccttgcgggggcttttccctcagtactttgcctcgaagtcctcgatctccatcttgaagtctgcggggtccttgatgtctccgcgggcgacgagcacctcgcgggtaaggagccagtagatgcatgccagggagcgccttcccttgttgttggtggggatgacgagatcgacgttgcgggtctcgttgttggcgtcgcacatggcgatgatggggataccgaggttcatggcctcggcgagagcctgcttgtcggcggcagggtcggtgacgacgagcacatcgggctccatgaagctggggttgatggggttggtaagggttccggggacgaaacggcctgcgaaggcgggtgctccgatggctttggagaactccctggcggggcgctgtccgtactgcctggcggaggcgacgaggatcctcttggggtcgaatccggcgaggaagtgggcggcggccctgatcctctcgtcggtcttcttgacattcaggacatagagtccgtcctgcctgaccttgtagatgaaatccttcatgtctgcgctcttgtactgggttccgatatggacaccggatgtgaggtaaacgtcctcgggtacgaggagttcgccgtcgataatctgaacgtcgtcgttgtcgctcatttagattcctctttagttcttgacaaccgtgattgggatcacgtctttgtcgaattccagcatggcgatgtcaatagggtcaagcatatccttaggatagtcgaccaggacaggtgcgccataggagatctgcaacgcgcgggagccgatgatcctagccttttcaaacctagtgtatttcataaggtcaccatactgaatgagaacgacgtacacggatgtcggctataaagctttcctttaatgttagtaaaaactactaataacgcacgcgtgcgcgaggagcaactaaaaaataagggcgctttgatagggaaacgaaatgtcggacgaactgaacgtatgtgcggccgcattcttccgcagcatagggaaggacgtcgtcacacccaaggaattcaccatgtacgtcacgctggacgtcaaatggatgtcctccaaggaagcctccgcactcatgcaggtcctgatcgaggagaaggccatggtctcgtccaacggatacctgaagcccggaaaggacttctcgtcgctccaggtccccatcgcctaccgccctaccgatgccgtcaggaatgcggtggcggccaagatgaagaagggaaagacccagacccctgccggaaaggcctcgggggccgatacaggggatatattcccggaacttgtcgcactgtccggggaatacggatggagcaacaaggggaaattcatagccgaatgcaactccgtccgcaagaagctcggtgtggagacggcggtggcggccctcctggtcctgagggactcgggggccgatgtgaaggaactgacggaaaaggtctacgccaattccgtcaaaaagggttgaaggggttttccggaagcgcttacttcttctcgacctttatgaaattgccgagggtcatcgtctgggacttggccccgccgctgacctggcctccggactggacggtctccttcagcttgatgttgagggccttctccagcttggcgacgagtttgtcgtccggtacgaggttctgggactccaccttgacgagggtccccttcttctcgctgatggatttggcgaactcctccatatccatgcccttcttcatacgggccttgcggatgacctctccgtagttatcgacgatctcgacggtggccgcaccggcgtagatgtccttggtctgcatacgcctctcgcgcttctccagcctctgctggatgaccgtgctgttggtggcaggggagccggtatcgtccctgggggccttgtagtcgtccccgaacttcatacagttgggacagagattgagcttcgatccctcgaccatcatagggcgggtcgtcgggacatctctgccgcacatctcgcaaatcatatttttcccatagttacggctcttcttaaaactaactgaaataccctggaactccgacacgggaggtttacggccgtttaagagcaatatgaatgacccagacttacgatttcctacatgatgcgggaatgcatcccgtcacccactatctaaaatgttaggataagctatttttaaatggaagcgattgtggtgccgtttaatatgcccgaggactccgaaatagaggaattgaaggctaagatcgtcaccctggaagacaggaacgttcatctcatgcaggaccttcagaacgccgagaacgagaaacgttactcggagagcgaacttttcagacttcagaaggacgtagcacgcatcagaggggagttggaaaggctcaaaagccctccgctggtgataggatccctcagggatgtcctccccgaccataaggtcgtggtgaagagctccaccgggcccgacttcgtcgtatcggtgtcgcagtacgtggacgagaaggacctcatccccggatcgagggtcactctgaacaagcagtccctcgccgtcatggaggtcctccccgctcccctcgacccggtggtcaccggggccgagatcatagataagcccaacatcacatacgacgatatcggagggctctccaaacagatgctggagctccgcgaggccgtcgaggaccccctcaacaggcccgaactctacaagaaggtgggtatcgaaccgccgaagggagtcctcttggtaggtcctcccggaaccggtaagaccctcatggccaaggctgttgccaacgccaccaaggccacattcatcaggctggtcggatccgaactggtccagaagtacatcggagagggggcgaggctcgtacgcgagctgttcgagcttgcgaaggagaaagcccccagtatagtcttcatcgacgaactcgattccgtcggtgcgaagagggcggacgtcgccacatccggggacagggaggtccagaggaccctcatgcagctgctctccgagctggacgggttcacccccaccggggatgtgaagatcataggggctaccaacaggcccgacatcctcgacgacgcactgctcagaccgggaaggttcgacaggatcatcgaggtcggcctacccgacgtggaaggcagacagcagatattcaagatccatctggcacatatgaatgtctccaagaaggtggaccccaagaaactggccgaggccacggaaggcgtctccggagcggagatcaagagcatctgcaccgaggcaggtatgctcgccatcagggcggaccgcgacatcgtgatgcccgaggacttcgacgccgcccgcgagaaggtgctcgacaccgacaggaacaaggtaaaggctccgcccacctacctgtacggctgataagaacggaggggcaatgcccctccccctttccagaccgaacgtcatgattatacgtcggtctgcattcatctgggtcatgtcaatcgacagcagagcggccgacatgctttccaagggattctacaaggaacgtctggagcccagcgaatgcgaatacctcctgaccttcagggacaggtcgcctgtggccaatctcgccatatccctggctgacagactgacccgcgccgaatgcggggatacgggacagatatgcgccgagatcgatgtctccaccggaccgtgtccgtgcaactgcaggttctgcagctatgcggaaggggtgacatccgccagattcttcgagatcgaggactccgtactcgtaagatatgtgcaggagctcaatgcgttctccgacgtcagaaggataagtctcatgaccatcggggatacggacatagacgaattggcgagaagggtcggcatcgtaaaggacaccgcaaaacgcgggacccagatatacgtaaacacccgcgacgtgacttccgacgagtgccgcatattgaaaaaggcaggcacctacggggcataccactcctgcaggattggagagggtacggataccgagatcaaggaggagaaacgcctggagaccatcgacaatcttgtttccgcaggactgtcggtgattgccgggaccggaccgatagggccggaacactccccgaaagagctgacggatgcattcttcaaaacagccgacagaagatgctgcggagcggacatctatgcccgcgagcccgtggccgggacaaagttcaattccatcgggaagatgagtccgtcccgcatgtcccagataagggcggtgttcaccctggcgacatcccgttacgacttcccgatcaacgaacccttccgtgggacgttcgtacagggacacaacgtatcctatgcgaaatacgattccgtgaaagggaaggaccaactatacgccgccaggcgcaggctgttcaacaacggataccagagggtcatgagggccgacagcggcaccaacgacctgaccctggcatatctgagacagacagggtcggtctgatcagttctccctgtccgcatcctctccgccgtggaactgcagctggaccgcggcatagatctccggaagacctatctccttggatgctgagacggcacgcatctcgccgaatatcccggaatcctcgagggccctgaaaagctccatgccgatgacggattccggattgctgtcctcgtccaggaggtcgccgtagagcgtatccggattgttgtaccaatcgaggatcctgtccacctcctcctctttcaggacgtccgatttcgacagaagattgattatgggcatgttcagcctgaattgtaccagcgatgcgagcgtcatggcggatacgaatccgttggcactcttgtacagggtcggatcggagagatatgcgatcatcgacctctgcttaccgagggcgctgatgacgacgttcgaagactccctgaaagcaaagagttccaattgaccgggggtgtctatgaggacatagtcggtgtcgatggtgtcaaggatgtccgagaccttcttgatgttgacggccatcagatccgccgccacgatctgcgccccattcggtccgagaccgtactgcgacatgacctcgtccagatttatccactccctgatatcgatatctggcacatacggaagtttctccgccccgggatccagattgaccactatcgagtcgatctcgttgtcatcgagccatctcttgaatgccccgaccattgtactcttgccgcttccggcagtaccgacgaagtagatgttgttcatggaccgtccctacgcccacctgtttggtgcgatatatcgttttgctttaccttgtaaagtctggctccttttccctaagaaacattattaaaaggggacggttttacgcctagttatgaatgcggatgcaaagaagcacgccgccgctttcggatggttcggagtattagccgtagcagtattttcaataatctggctcgcctgctactctgtagatacctcctgggtatggggaaagaactccatctcggacttcggtatctccgacaccgatgctgcttcgttcttcaaatacggatgcgccatcgtcggtgtcctcctcgcaatattcggaatcggcgaagtcgtcaacaagaaaaaattcggatacgttttcagcggcatcatggtcgttctgaccgggatctgcgtcatcatcgtgggattcgccgacctcaactacaagggcggagacatccatcacttcttcgcgatcctcgcagcgatcttcgccgcagccagcgccatagcgtggtccgcccagtcctggaaatgcggacgcgaggtcgtcgccgggatccccatcgtactgtcttgcgtagtactcgcatgcctgttcgcatacccgttcgagaagttcgaggtcatcgccatggtcatggtcctcatctggtacggactctattccgcgtgcaccatcggatacaacgtgaaggagtgaatcatatgaaaatgtcaaacaccatcaagaccggatgcgccctcgggatcatcggcggcatcgtcgcgatgatcggcctcgtgctctatctcgaggttgacaacagcgccgtcgtcaccatgagcgtatacatgcttgcagccgtcctgttcttcgcccttgccggtgctttcagtatgaacagccagtggtcctggaaggtcctcatgttcatgaacttcgtgaccctcggcatcattatcggcggagccatcgcagactactacaacatgtggtgggcggtcgtcgaagccgtcatcggcatcctgatcgtcatcgtcagcgtctccggcgagaccaagatgtggctcaccgagccccacactgcctgaaactaacacctttcccggtcggaagaccgggatcccttattttactacaatttgattggaaactaccatgtaaatggtaattcttaaatcaccataatcgattgacccttcgtggacgagaaatacacctttgccctaagaaaattggccctcatcggtggaatggacgactacgtcgccgtatcgtcgagagaactcggagacacgttggagatgagtcaacagtctgcgtctaaacgcatactcgaacttctcgatcaggggctcatcgtccgtgacctcggtgcaaggaaacagaggatcaagctgacccctgccgggatagacgccttgaagaaggagtacaacgaataccgcaggatattcgaactcaccgaccacataaccatccacggatccgtcaaggacgggatgggtgagggaggatactacatcggtcagaaagggtatgtggaccaattcgtggataaactgggattcaagccttacagcgggaccctcaacgtctgtgtggacaaggaagacgtcggaaaactggatgtcatcagggggaccgccgggatctacataaacggcttcaccgacgaaggaagaagcttcggggccgtgatcgcatataaggccaagataaagaacatcgactgcgcagtggtcgtaccggaaaggtcacactacgtcgacgtgatcgagataatatgccaatatcatctcagaaggaccctgagcatcggcacgggagaccgcgtcgacgtcagggtcagcctctgagatcacctcttggcgaggtacttcataaccgaagtgaagatcagttttccgtcaccgtcgtcggacctgtgtcctctggaccagtccgcggcggtatatgcggtcatcacacgctcgggatgcggcatcatacccatcacattccctgcgggattgcatatgcctgcgatatccgaaggagacccgttggggttccacggatagtaggccttgccgccttcgggggtgacgtatctgaagacgacctggtcgttctcctccagcttctccacgaagtccgggatgttgctcatgagcttgccctccccgtgtgcggagggggtcatcacaagcccgcccttcggtatatcggacgtccagacgcacttccccttgttatcgttcctgagtacggtgggacggcactcgaaacgaccggagtcgttgttgtaaagggcggcgttaggcacatcggccatggtctcgtcgaaagcaggcagaagcccgagttccaccagaatctggaaaccgttgcatactccgaggaccggtttcccggcctcgacgaaatccctgacctccttcccgataccggcctttatccttgcggcgaatatcgccccggcacgcacatagtccccggcggagaaacctccggggaatgccagtatgtcatagtcctcgagatccctcttcagctcgggggcgcactgtccgagaagctgcttgaggtggaccttctcggccttggccccgaccatcccgaatgcgttggccatctcgtcctcgcagttcgtaccttcgatccttacgacacagaccttaacgtcctccgctttcattgcgcagcacctcccatgatgttccagatggggtcgttccatgcggccctcatctcctctacgggtatctcgcacccgtccacgacgaacttgtcccccttcgttatgcctatgggggtggcggcgtcgcccatgatctccgtgaatctctcggcgtccctgccgtcgacctccgcgacccacctcgaggtggactcggagaacagcttgacattcatgtcggagcctcccatggcaccgaggtcgagctgtgcacctatctgtcccgatatgcacatctccgccacggctatggcgagtcctccgtcggagcagtcatgacagctgaggaccagtccctcggacatcgccttcaggagcctggaggagacctccttcagcctcttggggacggtagcggggacgtcccctccctttccgccgaacttcctgaagagcagggatgctcccatctcgtcctttgtgtcgccgacgacgaacaggcaggacccggtcttcttcatatccgcggtgacggccttcctgcagtcgtcgatcagaccgcagcagacgatcatgggggtggggaggatgtgttctcctccgggtgcctggttgtacatactgacgttcccggagggtatggggatgttcagttccctcgcgatgtcgcctatcccgtgcacggcctccctgaactccccgagcctgtcgggattctcgggattgccgaagttgagacaatcggtgaatgcgttgggcatcgctccgacggccactacgttcctgtaggcctcgtctatggaggccatgcctccgcggtacgggtcggcctcggtgaaccaggggttgcatccgacggcgacggcgagtcctttccaacggtctgccacgggcttgacgaccgatgcgtccccgggaccggtagcgttcatcttcccgaccatggggtggacgacggtggaggcgcggacctcgtggtcgtactgccttatggcccattccttggaggccacgttggggtcggacagcatgcccaggatgacgtccctgagtgcgggaagggcggggaactcctcgtccttcttcgacaggggcaccggcatgttgtagggcctgttgtagaccggacctccggtgaggaactgtatgtccatgtcgaagatcttctccccgttccagaacagacgggtgtgcccggtgtcggtggtcttcgcgacgggggtggctatgatgtcccacaggtcgaatatggccatgatcttgtcgacgttctccggcttgcaggtgcacatcatgcgctcctgggactcggacacccatatctcccagggtgcgagaccggactccttcagcgggaccttgtcgagatccacgtcggcaccgcagcctttctctatcgccatctcgccgacgacgcagctgagacctcctcctccgaggtccttcatgccggtgacgagatgcttctccgccaactctatgcatgcgtgtatgacgggctccttggtgatggggtcccccagctggacggcccctctggaatcctcctccgagttggacgagatgtcctttgatgcgaagttgacgccgtggatcccgtcccttccggtccttccgccgaagaggatcatgacctctccgggttcggacgcgtagttctccagaagatccttgcgtttcacgatccccagacagcagacgttgacgaggcagttgcccgtgtacttgtcgtcgaagaagaatcctccggataccgtcgggatgccgatcctgttgccgtaatcccttataccggatacgacgcccttcaccagatacttcgggtccttgatacccttggggaccttcacatcgcggtctatgggaccgaaacagagggggtcaaccagacccacgggctgggcgcccatgcatatgacgtccctcacgatccctccgataccggtcgcggcccctccgtagggctcgatggccgaaggatggttgtggctctccaccctgagggcgtagccgtagtcgtcatcgaacaccatcacgccggcatcgcctctggaaaggatgtcgtcgcggtccagtccgaacacgaactccttcagggtggatttggagctcttatagcagcaatgctcgctccacgcctgcccgagggactggagctccacgtcggtggcctccctcccctctttcacataatactgctgtacggccttcatctcgtcgagcgagagaccgagggccatggaggaggatatctcctccagttccttgtcggaagcgtccctgatgactatgtcgcacaggtcgtagggggcgttcctcttcaccatacgctcgggcatcggatcatctcacggtgaccgtgtagctctggaccacggggttcgccaggagtttcctgcagtattcctcccctgccttcttggcctcgtctgcgggcatatccaggtcgaggacgaaacattttaccgatttcacggaagtgatgcccttgaagccgagggactcgagggtcttcttggtgttggaaccctcagggtccgccacccctttcttgagctcaatcctgatgtcgattactgtcattggacaacatatcgcgcacgcgtataataaaaaatcgcagggtccggaaagaccctggcctgccgccgggggcggtcagaccgagcgtttgcgggcgaacgtcaggtatcccgtatgtcccagcatctcgaagctgggacgggtcccgccgttgtggacctccatgccgcgcctcatgatctccatggaacggacgtcggtgaaacccctgccgcgaagggcgttgaccgcgagttccagctggttcgcgttagggacataggtgcatatcctgccgccgttcctgagatgggggacgaggttgtcgagggcgttctcgacatccggcatgtcggtggtgatgacgtccgcatcatcgaaatcgatatcgacactgcgcgcatcgcctatctgatatgaccagtattggtccagtcccgtgcgtttcacgttcttaagagccttctccgcattctgctccttgaattccaccgtatggacgtgtcctgtgggggcgacggtgtgcagaagggccgtggtgagacctcctgaaccggcaccgacctctatgacgcggtccccggcctttatgtcgcactccatgaggatcgcacaggcgtccttgggcgtgatgatctgcgcccccctgtccaaggactccatgagctcgaccaccccgggacggaatacgttgaacctcctgccgacgatctccacgacgtccccgtcatccaatccttcgaagcgcttgccgtcgatgaccccgagaccgcccatcttgatcatgccgaactgcagtctgaaccaggacctcttaccgtcctcaccctggagatagaggaactcgccctcattgaatgccatacgaatccataatctgcatcggttaaatgcttgccgtcctcatcacgatgcgacggcccgttatctcccctatacaatacagcaggatgaacagaagcatcatgttgcggacgaagaccgaggccgctgcgaacgcctcccccgaaccgaagagaagccacagcatgagcgggacgagtatgacgaactggaggagatacagggattggaggatgcgcctcttcttcgtatccttctccccctggatcacgaacggcaggagggtgattatccacagcatgtactgggtggagaatatcatgaacgtcaggaggacgaccaggaccgcggatgccgaggaaaggaccagcacacggtccctgtcggcaggacccgtatccgtccgcaacctgaagtgccagacggcccacatgagaagtatgtatgccgctacggtgacgatgacccagcatcccgacagagcatctgccggggcgcattccacattgtatgtgtagctcctacccacgagctcgtaactgtatagacccagcatcccgaagatctgcagtatgttccccatgacgctttctatctggaaatcgcgtccggcctgctgcgtgaacacgcccaccactctgtctacggacagcccgcagacccccattgccgcgaatgcgatggccgccgccgcggctatgaccgccagcccggccgcgacgttgcggaaacggcggggatcggacctgtcggccagattgaccatcatgaagacggggatcaataccgccgggtacaccttgatcatggcaccgatgatgagcgtcgcataggaaagggtgaagcgacgctgcaggaacatatacagtgccagcaggacggttatggccacggccatatccaatttcttcacgatctcctccgagtacatcagaagcacgacgaagtacaaggcagtagtgcggaacctgttgagacccagacggccgcttatattcatgaccaggtatacggacgaccatgccaggatcatcatctcagccgcatggagacagtaatatccctgcagatcggacgacagcgccccggggatggctatgaacaagagggacaggggcgggttaccgaaagagaagtccacgtagggaagctctccggacctcagagacagccagttgccgtagaatacggggatgtcgtcggacgggtccagacacacgatgcagaaaacatacacggccgccaaggagaccgccgacaacgtcagcagttttctttcgcgggtggacaggaatatgtccccggccttttggacgaccgtgttcatggtttaccgggcccggggtacgggcccgtttggtttcaaagggtacgggcggcgtatgcgggcttgcatccttcctttccgcagcacacgcacttcccggtccagttctcgggatggtacggggttccgaggatcttgatgtcgtacttgtcctcgaacttgtgaccgcactccggattgccgcaccagccgatcttgacgatctgtccctcggggatgctctcggcacccatgtcctccatctcgtggatgaagctctgctgcttggccttggccttctccagcatgttggcggagatcgcctggaggatcatcctgacgcctgggaccatggaatccagttccaccgtgcccttctcgccgttatcccttctggcgaaggtggcgacgttgttctcgatgtccttccctccgatctccagacggagcggtacacctttaacctcccagtcgaagaacttggcaccgggccttccgtcgctgtcgtccagtttggaccttatcccggccgccttgagggccgccgccacctggcggcatacatccatgaccttctcctggttgtccttcttgaagatggggatgatgaccgtctcgagaggcgcgatggccggagggaggataagacccagatcgtccgcgtggacaccgacgacggctccgaggagacgttccgtcatacccaatgtggtctggtggacgaactcgtgctccccgccctccttctcgtaggtgatgtcgtagggcttggagaagttggtgctgtagtagtgggcggaaccgatctggagggtccttccgttgggcatcacggtgtcgataccgacggtgtagaacgccccggggaacttgtcccagtcggtcctgatcagcagggagtagggcagacagaggtcgtggcagaccgcatctacgatctccacgtcctgggcgacctgcctctccgcatcctccctatccgcatggcaggtgtgggattcgaagaagtggatctccctgacacgcatgaatgcacgggtctgcttggtctcgtacctgaaggtgttgacgatctggaacaccttgaggggcagatcctggtgggacctgatccaaagggagaacatcgggtacatcgcggtctccgaggtgggcctcacgacgagcctgacgtccagaggattgagtccggcgtgggtgacccagtagacctcttcgtcgaaccctttgatgtggtccttctccttcttgaactcggtctccgggatcagcagggggaagcacacctcgtcatggtccgtggcctccatctccctgcggaggaaggagtctatctggctcatgatcttccagccgtagggggtccatacgttcatccctttgatgggatacctcttgtcgcagagcttcgccttgtcgacggtctcgttgtaccactcgccgaagtcctcttccttcgtgggcatccttcaccacttccctttctgggcatccttgatcgcctcggcgatgagagatgcgacggatatgtgcgagacggggttgttcagggtgttgcagctgagaagtgcgtcgagggaactgcctgtgaacttctcgatggcgttgttgacgaacaccccgtgggtgcatgccacggatatgccggcggcacctgcctccctgagtgcgtatgcggcggcgatgatggtcccgccggtggagatcatgtcgtccacgatgaggaccttcttccctttgacgtctgccttggcgggtgcgatgcggacatccgtaccggagaggcgggtcttctccagatggtcgtacgggacgcccatgacctccccgaccatcttggcacggcccgccgcaccgatgtcgggggagaggaccatgtcgatgcccttccctttgaagtactcggcgatgacgggggcggccttgaggtccttgtggggatggttgaaatagttcaggacggcctccttgtgtatgtccacggtgatgacgcggtcacagttcatatccagatgctggcacatcaccttggccgattccggctctccgggtttgaagaccctgtcctgcctggcgtacccgaaataggggatgaccagcgtgatggacttcgcaccgagcctcctcaccgcatcctgcaggaggaggagttcgatgagcttgctgtcgggggacgtggtctggacgatgacgacgtcgtcgtccagtttctccgcgtcgatcctagtgtagcactccccgtcggggaatgtcgtagtagccgcctgaatgtagtcgcagcccatgacgctggcaagttcctttgccagatccatggatgcggacccgcctatcactatcatggatacggcctattcgttcccatattttatatgttcgcggacgcgcgcgacaacctgtgtcggacggccacatgggaacagatttaacggcggtcgcagatggatgtgccatggaaggggagataaagaacgtcgtcaccgacgagaggatagaccggtatctggacataacgaaacgtgcgctcgacaagatcaggatagccgcaccggaaaggtccttcaacaggaggctggcggacagcttcatggagatggccgtatcctactacaacgacgccaagcacttccgcgagacgggggacatcgtgaccgcattcgccgccgtgaactatgcgcacggatggctggactgcggtgcgaggataggcctcttcgatgtggatggggacgaccagctgttcactctcttcgaatgaccttcggcaattcgtcggtggaactgcacgcatacgtcctgacatcgccgagtacttcccggacctcgtcctcggaggcatccgcgaagatgctgttgcccaacatgcacatggcggacatcatccccgcactgcggagtctggctatcgcggaggcgatctccgggccctccaccccggaagaagcggagaatccgttcgatatcctgaaaagcgctcccttgtccgggctgcgcatgaactcccccatcgccttctcgcctgcggacgatatggaacggaaggccgtcccgtcggcgaggaccttccccgtatccatcctggagcccaggaccgccagcgtcagcctctcgaaccttatccccgtacctactacgcgccccctcggggggagccccgggtcgacacgtaccggttgatgcaccggacacgatatcgcagacacgtctccgagccctcccccgccgactatgtcggccttatgggccgccctgtagactgcgggcatcccctctccgaggatgtcggccgcacacaaggcgacggctatggcgcccgaggcgctcataccgaacccctccccgcagggaagaccgttggacacgatgacgtcataccctcttccaggaagcatctgggacatcacatactccgtgaccggggcggacgtctcgacaccgtcgatcgccacacgcaccctgtcgtcggaacgctcctccaggaccgcctcggagccgagggacagccttatccccgcccctctggagcctctgcgcagcagatccgcctgcccgggatcggaaggctggaagaagcatgtgatatgaccgggacagaacgccttgaccatcgtctcagagtctctgtgccacgaagttgaggatcatgtcggatatggccgccttgctgcccgtgatgtcggtggcctcgtccctcgtgacgaggatcatggaggcggacgtcttcccggcggaatcgacgtcgttggcgacacaggccatcaggtcgtactcctccagcctgcctctggcctttttgacgaggtcggaacgggacagaccggattcggccttgtacccgatgacgttctggcacttcccgcgtatgagcgggagcaccttggggacgggtttgagactcatggtgaatccctccccgctggggatcttcccctcgaccttcttctccggagtgaaatccgccagggccgccgggacgatgacgaggtcatggtcgatggaccccaacatccctatcaggtcgccgaccgtctcatacctcttcacgggtatgaagtctgggacatcgacgctgccgccccccatccagagctcgacgtccgccccgcgctcgaaggcacgctgtgccagcgtgaccgccatgaggcccgaggaacggttggttatcagacgcatggagtcgagaggctcctcgctcctgcctccgatgacgaggatcctcttcttcctaaggtcgtcatgggacagcagctttatggcccatgacacgacctcggagacggaggcgacgcgcgccctgttctcgtcggtatggggaccgatgatgttgaccccccatgacgcaagtacaccgaggttcttctcgacggccggattgcccagcatgtacccgtgcatggcgggggccacggccaccgggatcccgctgccgagggccacggtcgccatcgtggtcacaggggtgtcgtctatgccgttggccatcttggagatcgtattggcggtcgcaggatacaccaggaaaagatccgcatcggaagggtcccccagatatttgatgtgctccgtctgcccggtcatctccgtgacgggcttcaccccggaggcgaattccatcgcatcgggggccacgagcttcaccgcggcaggagtcatgacggggatgaccttcgccccgttcctgatgagctccctgatcagatggaagcattcgaccgccgctatgctcccggttatacccaagactatggtcttcccggaaagcctgttgctcttgtcacagtatatctcttcactcggatgcatacaatcccttctccctaagtgcctctaggacgtccgcgaaaacggcgtccctgtccttcgatgcgtctatgacgcagtaaccgaacctctctgccaggcgcagatatccttcgcggacgtccctcaggaaatccagcttctcgaacctgctcttgtcctcccctctggagtccaccctgcggaggctctcctcgggatccatgtccagaaggaacgtcgcatcgggttcgatgacggcgttcttctgcatgcctatgagccactctatgtcggcgtcctctcccatcgaggcggactgataggcgacggtggaccccatatagcggtcgcacaccacccacctccccgattccaggaccttctctatctccgcggtgtgtatggcgcggtcggccgcgaaaagcagggcctccgccgccggaggtatgtcccccagctccccggagcgcagggccgaccctatccttccggacgtgggctcggaagtgacgacggcatccccgaccagatcggcgagcctcttggccaatgtcgtcttgcccgtgccgtccactccctcgagaacgatgaacctgcctctcatccttgctccgcatatgcttggacttacaataaccttgggtcggcggagagcctgtcgacaagggagtcgagggcctccacatccttgatgtaatgccgggagagccgggacaggtcctcccgtaccgagccgtcgatgtcggggttgtctctgccgaggatatcgcggagcgtcgccgccagattcccgccgcggcggtcccagtcggtcaggatgacggccttccccccgcgggactcgacgtactcggcagcggcggacggacctccggaagactggatctggaaaacatcccctgagatgccgagatatgccagtgcctcgcggtccttcctcccttccaccagtatgacgtggtctgcggacagttccttcaatctcccgaggaccttcaggatctcttccagacggacctcgtcgctcatcacgtcttcatcagtcttgcgcatatctcgtcggcgtccccttcgatgaatacggtcttctgtctcgacgtgtgtccggcggagatggatgccttgtgcccggatgcctccgacatgacttcggcgacctcctcgttggccctcccgtccagaggaggtgccctgaccctcacgatgagacgtctcctccattcgtcgaaaccctcgatgccggtacgggacgacctcggggacacgaggaggtctatctcgataccgcccctgaccctgcggctcacgtcggacaattccatgctggcacatatggccgtatgatattattctgttttccgcccaagataaccccgcacatgttcctggataacgcttaaaatcgggtttccctatccccggatgttatggaatctctcagggaacccgccatgtcgttcaacgaattgggcgagctcttccgcatggaacacaaatcgaagatgctcacggaggtcggcggagacctctaccagaacatagcggagcttctgaggtacctcaagaagaggtacgaacagcagctctcggcggatcccgagaaccctaagaccgaccgtgcgaaccaggagaggatcctcggtacgcagagggcgaaggccatagtcgacatgcgtatggagaagatctgcaagatggccctccgcggggccatgggttccgtcaatcccatcgataaactgaccagggaggagaaggagtactacgagacgatcctgaagcactccgtgtcccatcgcaagatcatagaccgcctcagcgggaacatacgctacaggaacacggagatcgtccccgacacgtcggaagagaaggaggagcttcctcccgccttccacgtccccgagacggacgacacccccttggaagacgagcccccggcgacggtgtccgtccccaagacccttcctgacaccatacccgacgactggggggaatccaacgacgacgtccccttggaaccgatcgaggagatcatgcagagcatgccggaggcacctgtacgcgaggagaaaccgttcgtccccccgatagatgatgtggtatcggaagacgaggaattcgatggcgagatccccgaggacgacctcgacaggatgatggcggacgatatgccggtcagagcacctgccgagaagaagaccgtgcctgccgggagggaggaacccaaaagggacgacctcgtcctgctccgcatactggtggacgtcccgatgccgatagcgggacccgacggtcaacagtacgttctgaaaaaggagaatgtcgtgagaatgccggccatgctcgcacagatgctcgtcggcaacaagatggccgccgaactgcacccctcaccttgaaacggatatcgtgcgggtgtcgccgagcctctccagacagtctatcttgaatcttttgataccggttatgtcggagaccgtctgcctcgcgatgtcgggcgtgttgttgttcttgctcaggtgggcgaggaatatcttcctgttctcgttgacggcggtcttgcgtatggcgtccgcggtgaccgtgttgcacagatgcccgtggtcgctggcgatcctcttcttcagaggttccggatagggcccgtcgcggagcatcttactgtcgtaattggcctctatgacggccagatccgcctcctccagggctttctcgcattggaaggaaagcttcccggtgtcggtggccacgagaacgttgctcccgtcggccttcagcatgaaggcgcagggctccaccgcatcatggaaagtggggagaggggtcacattcatcccgcagaggtcgaagctgcccatcatcctgatctcgcgccaatccaccttccccgcgttgaaggccatgaaagtgttctggttgcagtacagggggatcttgagcttcctcgccatgacacctgcccctgccacgtggtcgttgtgctcatgggttatgagaagggccttgatcgtactctcgtcgataccctcgagttccatgagcttgtgggtgtacttgtagctgagaccggcatcgatcatgaccgcctcgtcgtccaactgaacgacgatgcagttaccgtcgcttccgctggccagaacatgcacttccagcatggccgaccttcagaccttcttcttgtagatcgcgaagatgacgtccgagcgggacacggtacctacgaggatcccctgctcgaggacggggagacggttgacatccatcttcatcatcatcctgagggcctcgacgatctccgcatcgggagtggtgtagagggtgctgcggaccatgatgtcctcgaccttcataccggagaattccttgttgatgagggtcatgtcggcactctggttgtcggtatccatcggctgactcaggaggtgttcggaatggatctcctcgtcgagtttgtcctgatatttcagaatgagctggaggatgtcggtctgagagatgaccccgagaacatggttcctgttatctacgacaggtgcaccggtgacattgtccaaagccatcttgataaccgcctgcctcacagtatcggtcggcttgaccgttatgacctgcgtggtcatcaaatccctaacccttaactggaccattactacacctatatcgcgagattgataaaatgtttcccattatccaaggttggaaaagtcgcccggccatctgtacgataataagatttattaatgagaaatatatcggctggaatatacgggcctgtagctcagctaggtagagcgtccgactcttaatcggacggccaagggttcgaatcccctcaggcccgccatatctttgaccttctgtcagccttgaagttattcattcgccatttcattcctcccatattgcaatcccaccatcaccagttttatatcattgattaatgttttacatatatagaaagtaaatattcggtgatagaatgaaatcaggagcggtcgcaaaatacatagattccatcgatgacgggaccgtttttgcgatatgcgacatacccaatgattccagctccgattctctgaagactcaactatctgttgcatgtaagaggggccgcatcgtgcgcatcatgcgtgggatatattacaaacccaaatacaacaaactcttagaaaccatgatcccctacaatccagacgatgttgcatatgcgattgccagaaataacggctggcacatcatccccggagggaattcgtgtcttaacctgacagggctttcgacccaagtgccttctcgtttcatatactattccgatgggccctacaagacatacaacataggggacaccaacatcgaactgagacacaggggatccaaagacatgcccgattcggacggattggcgatacttattcacgctttgaagaccaaaggaaatggaaacctcacccaagatgacatccgtacactgtctgaatatgtccgttcacacggagttgctatggatcccgccgaatacagcaggaccgcgccctggataaagaaagagcttcagaggattgccgatgtacagccactatgagatagcaaaccttcccgactcggacctcagagacatatttttgcaggtgagttcggaaatgaacattccgccttcgttgattgagaaggatttctgggtttcattgatgctgaaatacctgtactcggactctcctcggaaacacaggttgctgttcaaaggcagcacatccacttgatggtcacttgccgtaagccttggagcggtggcgtatcgcaaccaccagaatgacggattcgctttcgcggatctgtgcacacacacggtaatcccccacgcggtacctccatatacccgcatactgacctttgagctctttcccgtgaatcctcggatcctcacagccttccagattcttccttagccaactgcggatgtagaggttcaccgaatgatccaattttttaagattcttgtaagcttcctcgtccagaagcactttgaatgtcatttgcggtcgaactcctcatcgagctcgtccaatgtgtatgcctttcccgtagactcgtaatcggcaatggatttgaggcaatattccaggtcaatctcgtcctcgatcatctcgaaaaatgcccggcgaagagtctcagatacgctgattccgtgcacattcgcataattctcaatcagaatctgctcctgcggggaaaccctgagggatatagccatgataatgtattactgtgtattacatttaaaacttatggcaggaacacctgaacagcctcagttgacgttggtaggtcatcaaaaaagaataggaactttagatggtgccacattctaggatcaaaccattctaacggaccgcctggctgttgaaatagttagaatagttagaataatccgaacttcgaaactcctggaaaatcgataagtctaccgtgcgggttccctcaagcccgccacttgtcattctctcttgaacggcgacgccgaatacgaaaaaaacagcctgatccgttactcttttggagagcttacgctaccgataccatagacggccgacccggtcctgtcgctattgtaaaacattgaatcctcggagacagaagggattcatgcctttcagaggggttgtgcgaaggggaacgtccggagtacgggcatttcattatctattcattatctatcttgttgtctacaataacagatacaaaacctctcgccaaaagatttctaaaactttgataaaaggtcggatccgagattgctaattgcgaaaaatcgattttctgcaattaaagatgactataattgcgtaaaatctaaaaatcgcaattaacgagacgacgtcggtcggatgacctgttccaacggatctgttggcagttgggatggtcgaagtgatccgaaaccggaaatccgcacgagatcgtgcggtcattgagggggcgattttgtataccggcccgtgatttcaatcgcgcagggtcgctatcgggatcacaaacactccgtcgtccctgcgatatccgtactccgttcccgtgattacgattttcagatccggctcccttatcgatattcttgcatcgacgttgttttcacgtatcaaggattcgatcttcaacagatgcgctgcaccttcatccacatccttttgacccagttttatttcacacaacgcatatctgccatccgagagatggaggaccgcatccgcctccaacccgtacctgtcatgatagtaggagacggtaccgccgtattttgacgagtatatcttcagatcccttatacaaagcgattcgaaaagaaaaccgagggtgttgaaatcgctgttgaaatatttcggacctatcccaagtgccgccaccgctatagatgggtctatcagattcttcttcggagatgcacggattacggtcttggaacggatcgccgggcaccaggcgtccacatcggcagttatgtacaatttggacaaagcaccgatgtaattgtagtatgtgctttcgctgaacggatactttgcattcacgtcggtgattatcgtcttattctcggccagctggcatatattacgggaatatgaacgtaacaattgtttcatcaccaaggggttgcgtttcaccccatccactttggaagaatccacctcgcaggtctgttcaaacagatccttggctatcatcagactgtccgacgccttgtggatattcactgcggacggccaccccccgcgacagatcgcatggatgatcccatccatatccagatcggagtggcacccgtcgaatcctcccggattgtcgaacagatccattatcgaaacggttccgttggattctccgctttcgaataaactcattgggtacatctgcagtttgcttatacgcatggtcccggtatgtggaacgtctacatctttggaagtcgaccccgtaagtatgtattgtcctgttttctgtgtatcatccaccgatttgcgtatcgctccccacatcttcggagcgtcctgccattcgtcaaagagcctgggcttggccccttccaataatttggaaggcatctcggatgcgaccgagagatacccctcccttctgtcctcgtcctggaactctattacgcttttcgccttctgtttggcagttgttgtcttaccgcaccctttgggcccggtaatgactaccgctccgaaaacggatagttttctatccaatatcgaatcgactatacgcggacgatataccataccaaatcatttgacaaagagatttgaggtattttaatctagttatttgaggtatttcggcaaagagatttgaggtaatgcgccgcacaacaattaaaagcgatatcgacgagcatgacctgtacattgaaagacggtaaagcatcatccttttccgacagaccggctggcagtcatgatggttggaagaatatgtgacctgacaatctccgacaacccactagaatgccttgcagattccttcggtgtcattgaagatcgtcgtcaccggagaagagtctgattacatagaaccggacgggacatacatagccccggagggcataacggtccctaaaaagggtaaaggggtccgaagacccctgttttatgctcagttgtcgtagtagtagcagacgttgacctgaaccgcagagttagttccgacgtagtccgaaacattctccgaggagatcttggactctccgttaatgatcaaagaggttgaatcctctgtgaatccatatgctccggaagtgtagtatgcagcaacgacgtgaccagaattaacgaaggtggagtctcccacctttccgatcgaatcgctagcactggcattcatgttgacggtaacattatccagattgatgttcacatttccgccgcggactacaaatgcagtagccttgtcagacgtcatgttgaacgttcctccgaggatgttccagtttccatcctgagccacaaagactccgcatgcaagatagccggatgtaactatgccgcagttgaatgttccaccggtgatggtaacatccacgggtccttcaccttgagtgccattagcggtgactgccacattgtcgattgcagtgaattctcctccggttatgacgaccttgctgccgttgactgcccaaactgcatgttcctgagcggttacagaacctccggagatgtacacattggctccactgtcatcctgattgctgtagcccgcaactattcccatacttgtagaggatttgagatttcctccagccatttcgaaataaccgccgttcaccacattcacagcgctccctgtggctacgatgattccgctgccgtcacccatgtcggtaagatgaaggctgccgccatcgacaagtataccgacactggcatcgacattgagttcgtgtccagataaatcgagggtcacgtctgcatcctttgaaacagacagagtctcgtcgatctcgatatcgtcactgagggccaccaacatcttgtctccagaaagtgcactctggagttcgtcagcagtatcaacgatggaaacggccttggactgcacaaacatcgtgtcgacctggaaggagtagctgtgattcatctgaaggtcagcattgccgccgatggagtatgtgacatcggcatgcgaatcatactctccgatcttcgggaagaaataccatccgtcggtcaaagactcctcacccatgatctcagagtactctacctggatatgatcgtcctctaccttttcatccgtggctacatcgcacatggacaccatgacaaggcgtgccccggaaacagtggtgctgtatacaagatcgtaggagatctttacaacagtccccggctccagatatatgccctcttcagtaatgcgtatgtcgaccatggtggggtcgccctggtcgcttcctgcttcacaagccacatcgacaccgtcgatggagagtttgtagttttctacggccagatccaggcctccggtctgtatttccagacttgcatcctcttcatccgaccaccaggagttggtgcttccttcaaatgccgccaatccgacgatggccactacgaggatcgctgcggctgctgtcagttttgcattcatctgcttaccttctattattcttctctcttatccgaccccgcatatgcgggtaagaggtttcggcacctgtcctcactgaccctccacatcatatgcgtagacacccagattgaaagacaggctctgattcatggtatcggaccctgcggatgacgacatcctcagagtgaatgtgatctccatcccgccggccggaacggatccgacatcggtctgcaggccgcttccgtcggcgatcccgtacagatccccggagaacagcctggtccctccggattcggcggtcaggatgatgttcttggacagtgcacagttcttggaggaatcctggaggttctggacccagacgcaggcattgaagtccacgccggaaagcccggtctcgtcggacaccttgaccttgaacgttatcgcatcccctcccggctccaaccccttcagatcgaaaacgtactgggacagacgttcgttcacggccgccccgttgtactcggtgacgtatgcggtgaactccccggacgccttcttcacggagaaggaggcctccaccgtcttgtcggtgttggaataggactccgaatagcgtacggtcacggtcacgacgccgctcttgccagtaagatccgtcggagacagctcgtaatccgtcaccacccgggaggaaccgtcggtgtaatacgctgtgaccgtcagtcccgatgtatccaaggtgttctcggacgatgcatagacggtcttgctgggaccttccacctcgatcctgtccaccacggtatacttctcgaagaccgcggacacggcctggtcctcggtcagggcggagaacacatacttggaatcggtcagctgggcggtgacgtcgacaccgttgacggtgacggacttgagcccataccagacgtcgggggtgaaggtcagggtaagagggtcgccgtaataatacggtgcctccgaagaagcctccacactccctccctctgtgggatctatcgataccgttatgacgatcctcttgaaggttacggagatctcgtggtcggcaaggacgttgctgaacacataggtcccattggtaagggtgccttcctcgccgtccaccaggacgaaatcgtaggtgtatccctcggacggtgtgaagaccaccgtcagggactcattctcctgaaccctctggataccggacgggctggcacttccgttctcccctgcggagatctctatgtcgaactcgaccttccagaacgttacggcgacgacatggtccgccctgatatccctcaggacgtacgtaccgtccacgatctcgacaggaacaccgtccaccgttaccgaatgcaccgcatagcggctgtcgggagtgaacgtgaaggtcaggtcggaaccgtattcgaccgcctgggtctgttgatcgcaggacccatgctccccgacattcaccgtgaccgtgaacatcagtatctcgaaaacgacctcgaccgccgtatccctggctatattgttcaggacgtacacgccccccgatgtggggacctcgacgttatccacaaggaccttcgacagcctgtatccctcggatggcaccgacgttatggtataggaattccccttcaggacctcgtccttgaaagagtcgctgttgtcgttcaccgtaccgtggccgacgatggccacgcttacggaggcatatgcggaatcgtccctctcgaagaagacctccacggccttgtcttcgattatatcgtcgatcacatagttcgtacggtcgtccgggacgatcctgtcccctccgttgatggtcagataggacgtcctgtacccgggctcgggtatgaagactatcttcagactcttcccgtactctacgaccgacgtcgtgggatcggcacttccgttctctcccgcggtgaccgtcacggtgtaggttatcacctcgaactcgacacggacggaatgaccggagacgacgttgctcaagatgaacacggaatccttgacctcggaggtcacatccgtaccatctaggatgacggatgcgatacggtaaccgtcatccggagtgatcgtcagctcgaggtcttctcccctctcgacgaccacggagccgctgggacttacggtcccgttgtccccgacactcaccgtgacggtctcggtgtattcgatctcctcgaatgtcaccgatactaccttgttaccgtcgatatcggaaagtaccagcttgccgtcggaaagttccacctcgctgtagttcacaagtacggatgacaccatgtatccgtcgttcggagacaccgtcagtgtgaccgaaccgccggcggccacctcgcaatcggagggggtcacggacccatggccgttgtgttccgcatggatgacgtacatccccggatccacatccgtcttcatgagccagagttcgatgctcatgtctgcggttatgtccccgacgacgaacgtctcggacggaggcacctcgttcccattgatcctcatgtcgacgaacctgtatccgtcggcgagggtcaaggtaaacgttacagacgtcccggggaccaccgatatggtccctccgggggtcagcgtaccccattcgtacgtcttggagacatccccgataccgccggtgacgatgatacccattacttccgttatcgaaacgtctacttcgacctcaacgtcgtcggaggatgcctcgcggaaatcgatgaatatatcgcggtcccggtccatgaacacattcaggttgttggtaaggccgacaggttccccgtcgaccgttatgccgtagatgacgtatccgtcatccggcgtgatccacacatccgccacggttccgaagggatacgaatcttcgtacgatacggtcccgtggccggaagtctcgacactcagcgaacgggtaccgtccggactgtcgtcccatgtaagagtcaggacggcggccaccgtcacgatgcatacgattgagacggcgatggcggccacctgttccgatgtcagcctagctctcatcattcgattattcctccttatccccttctatcgaccctctcacgccatcagagcccttgccgcgcctcgtcttcactatgtcccagatccctgaaacagccaggatggagcatggtatgacgaccagcaggaccttgcccgcgaacgtggagaatacctccaccagacttcccagcgtaggggagacaccggtcaccttgccgatgatgtccccgctcgcagatgtgaccgtctgagtggacggagacgatggagatctgtctactatcgcatcaccggccatagtgtatgtatagccggacgggccggaggagatggcgattatgcggtgcgtgaccaccatgtcctcccgggttgcgggattcttgtaatggaacgtcaggacgtccccgacctcgagggaggagtagaaggagtccgacccaccgtgcctgatgaataccatgctgccgacggggatcgactcgatgtcgtagccgctgcgcggctcaccgtccatcgaggcggagacgaccaccctcacctctgtgtcggagaagtccaaggagcctccgttcttgtcggcgacgtaccagactgcagatacggctatcgctaataccgctaccagtgtgatcgctttcctgcgggagacctccatgacgctcacctcgtttctgtcgtttgatttaagggaggggcccggaacgggcccctgtttcaaactcgatcaagccccttcgatcttcttcgaacatcctgtgacggttacaagatcgtcatagtccttccagtcttcatcgacccatactgcgttgacggtatcggcagagacattggagatgtcattgccgaagccccaggtgatgtctgctcctgccgtacttccaacaatgaccgcagacttggacttggagacaaaggtcgagttggaaaccgacagcgttgtcttttcgggttccgtcacatactgatcggagatcttgatggcacgaccttctgagtttaccttgagtccatctatggttacatctccgccagcgactatccagagggcataatagtcatgtgattcgttgatggagacattctcaaggaccgacgtgaattcagaattgtcgagggccactgccttctcaaaacatatgtctttgagagagacattgcaattcaagaacgtgatgtcgtatgaattccaagttccgctttcctgatcgcttgtaacgtgcaggttgttcatggtgaggacagcattcgaattggccatggagaccctggaccaatacgtggtggagagccggaggatttcagaaccttcggaaccggatatcgtcaccttggaagtgttcggacctccgaactttatgtatgcatcggaaacatctatcgacgcatttccattgagaacgacttcgatcgtatcgaaaccggcagggttggaagaagtggaacagatcaacctgttgatctccccctcatcgaccctggttttaagatatcccgatatggtactgtcttcgacaacacagccgctgtcacggcctactatcgttccaaaacagatggatgaaccatacctattctcgctgctctgtatgattgtcagattctcgacggagttcttactgatgacggggtcatagttgtccttgactgcgattcctacgactcctccgatatccctgtaacccttgacgatagtgtcttttacggaacactcgtacactccgccattactcttgaatccgacgattcccccgaccttgtcaccgttgtcataagacgcacctaccggatagggggctgcactcagactcgaattggaaacctgacacttttcgatgactccataggtatatccgacgatcgaacccacccaatggccacctacaaccgtagaattatccacgcttatctccgatattgtagatgtaggggaggataccgctgcgaacactgctacactctcccttccgattacactcgcatgatcgaagttcaaggaggttgcagaaggtccgctgaagttagcgaagaacccggccctgtctcctgcagatatgttgaggttgcttatggtcttcccattaccgtcaaaagtacctttgaacgagtatgtgctggtcccgatgggggtccactcctcgctctccaggtcgatgtctgcgaggagtttcacggtcttcccttcgcaggtgttgccgcagttcacctcggcggcgaacgcacggagctcggccgcgttggagatccccactatatcggtggatgcgttgctctggaccgcctccgccctgagcgtcatgctgagggtggcggactgcgtcgcctccacgggcagccccacggacacggcgacggcctctatgaggcgctcgccgccgtcggtggccgcctgcagcgcccactcggtgctgaagtaccctgtaatggcggccccgccgaccgatatggagaactcggaactgttctccccggagaccgtacagaccatcctgtagagggtggatacggtgctcaggttgtaaacactcatcaagaaatcgaaactgtcgccgggcgtcatgtcggacgcggtgacggttatgccgtccgctgcggaatatcctacggcagcggtcccgccgttggtgaatctgtcgcttacctccacacccagggagtagaggctgatttccccggcctccgccctgatgtccaccttgccggtggtcacgtcgaccgtcgcatgctcctcgtcggagaaccacgactgggtgacggacgtcacggccgtcaggcagagcgcggcgacgaccgccgccgcgacgatcatttttgtttctgctttcattgtcatccctttttccgtttttatctgatagcctccggattcttccagcagattccctgaccgacgtcgtatgatgaagttgcccgggcatgtgtccggaggcttcgaaataaaaatcgcgcccccccctggcccgaaaaatcgggccggtgaggttctggaaacgggtttttacttcttacagaaaatattgcttatccggacacttatatgttgtgtaagataacttcaaaaggttatggttttcacatagatgtgccgaaataccccgttcctcccgcatcggacacatgcagaagatggaccgcgtcccggcaatctcccgacatgtgtggccatatccctatgatttaatcccccgaagacggatatttgtacgatctccgcgatccgtcctgcatgaaacatgcgaaagggatgcccgccggacaggccctggagaggctgaaggaggggaacaggagattcctggtatccgagaaggggtcgggggacgtctccccgtccaggaggagggagaccgaggagctgggacagcacccgtacgctgtggtcgtcacctgctccgactcccgtgtagtccccgaaagcatattctccgccggtatcggcgacctattcgtcatccgctccgccggcaacatagtggacgggtgcaccctggggagcatagaatatgcggtagagcatctcggatgcaatctggtcgtcgtcatgggccacacgcactgcggggccgtggccgccgccctcgaagggttggacgaagggcatgtgggactcatactggacgaggtccgcgccgggatcggtgaggagaaggacccggacagggcctgtatcctcaacatacgccacagcatggacgtgatcgggaaggacctccccttggaggacggcgccgtcatcgtcggggcactctacgacatagggtccggaagggtggatttcctccgagaccgtacgtcgtgaccctcctgttatttaggcataccaaaattatttaaaggatttagtctatcctaaatacagcacccggaaaaggggtgccgcgcactaaggggatacgaagaaaggaggtgtatgcgaagaagaaggaagagggatcgcttgaaatctgatggtaatccaaaggcggcgccttgtgcagagggcgccgcccctccgagtacgtccgttttttccataccggacacacgggagcaacagtttacataccatgataatatttagcacgcatgtcgtccataacctgcggattcatcggtctcggcctcatcggaggctccatcgcccgcgccctgaaagactccggagaggaggtcaggacggtcgcgtacgataccaataaaaaggctctgacgcaggcctatcaagacggtgtcgtggacgtcctcgtctccgacatagactcccgcttctccgactgcgactacatcttcctgtgcgcccccgtgaaggtgaacatggagaacgcggagaagctgaggccgttcctctccccgaagaccgtcctcaccgacgtcgggagcgtcaaaacggagatgcacgtcaggatggaggagctgggactcgggcccgtgttcatcggggggcaccccatggccgggagcgagaggaccggctatgcgaactccaaatccaaactcctgcagaacgcatactacataatcacgaagacgcccgagacgacgcaggagaagctggacggataccgccgtctcgtgaaggcgatgggtgccatccccctcgtcatgacctacgggcagcacgacttcataaccgcggcggtgagccacgtcccccatgtgatatccgcctccctggtcaacctggtcagggacagcgactccccggacggggagatgaggatgatcgcggccggagggttcaaagacatcaccaggatatcgtcgtcctcccccgtcatgtggcagaacatctgtctgaccaacgcggataacgtctccagactcctcggggactacatagactcgctcgaggagataagaaaggccatcgattcgaaggacgaggacaggctgatggacttcttcgactccgcccgcaggtaccgcgacactttcatagacgcatcctccggacccataaagacggacaacgccgtccacgtggagatacccgacgagaccggtgccctcgccgtcgtcataaccatgctcgcggcccagggaatagacgtgaagaacgtcggcatcgtccacaaccgcgagttcgagaccggctccctcaggatagagcttcatgacgagaacgacgtgaagaaagcggagaaggtcctcgtcggccacggctaccaggtcaccgtgggatgacccgtcccccgggcctccgccgggagttacaaccacctatatttaacttatcctttatctaaaaggataaggccgttttttacaaaaaacaggaatgtattgggattttttcgatatacgtagatattttttcttaaatcgataaatatttacgaataacatcaaaatagtgacggatttacatattgtatataaaattttgttcgtaatcctttatatctcaatcaaaccgttttgtaaaatgcaggaaatgaacgggacttgggaacggtcgtgatatggatggatgcacggaacaaggataagctgactgcactggtcgcaacaggggttgttttcgtactcgtcctgctcaccgccattgcgaccgggaacggctcggtcagcataggggacacggagatcaggttcatcaagaccgactccatggacggaggcgatacaggctacgagataggctccgtcccggagaacagcctcgtcaccataactccggtgggggacatctcggaggtggaggtcggcgacgtcgtcgcctacagcctctcgggatacaccataatccaccgcgtcgtatcgatagacgacgaaaggaacaccgtctacaccaagggcgataccaactacgccgccgaggagatcagcgccgaccaggtctacggaaaggtgaccggggtctccacgacgctgggcttcttcgtcggattggccaaggacaggctcgtcatggcaggggccatgtgtctgtgcgtgatcgtcatagccctcagcatggccgatatcgtccgcgccaagaaggctgaagggggggggggaataattgttcccgaggactccgaggaatgacggcaggggatccgccaatctgaacacgcagatggtcacgatagcggcatgcgtggtggccatagtcaccatgatatccatagcagggggcgacggggaaggagacctgccggatgcgaatccgaacctgggattctcgtactgcgagatctcccactcggatgacgggaggatcaggacctccccctccctgtacggcaacagcatgatcaccatccatcccgagatctccggcgacatagacccggacagcggactgtacgaggcctccgccaccgccatgctcgtggtcaacgacatgaacgaaggccccatagcgctgagggtgtatctggatgacaggtcggtggtattcgacgtcataagtgtgagatgccccggagggatatcgtactcgttcgccgacatatcctatgacgacatcgcgaggaaggcgttctccatcgggaacgtccccacggggacctattatgtgaacttcggactcctggtcgaggacaacgacgacataacgttcaacctggcctgcatgaacatgtgaatcgacaccgattaatcagggcacgtcatcggggggagcatgcaggagatagacctctcccgtctgggagaatacgttgatgcgatagacgacatccagaacaagtggatgctggtgacggcggagaaggacggaaaggccaacaccctcacggcgtcgtggggagggctcggaagcctctggagaaggaaggtcgcattcatattcataagacccagcagatacaccaacgagttcatcgaggggagcggcaggttcaccctgaccttcttcgacgggcagaaggatgcgctgggatacctcggaaagacgtccggcagggatgtgccggacaaggcggagaaggccggtctgacacccacccacgtcgacggacagcctaccttcgaggagggtcgcctcatgatatcgtgcaaagtcctctacaccgaccccatcgagagggataagttcgccgatccgaggctggacgacgagatgaaccccgacggaaaccgctcgatcatctacataggcgagatcgaaaaggcctacatcggatgatctggcacatatgaagggaggccgtcaggcctttccccttttcctttccaagaccttcttctttatcaggaagaccgattcggctccgctgcgggagaatacgtccgcaccggccctctcggccgcctcctcggagacggtcatcccgccggcattgtatacgaccctgtccctcagaccggcctcggtcaacatgtcgccgatcttctttatcttggacgatacggaggcaaactccccggagacgcagcacactgtgacatctggctctttgcagaaacctacgatgtcgtcctccatcatacccatctcgacgatgttggtctcgaatcccgccacacccaggaagagggccatcgtgttcctgccctcggtatggacgtccagggccgccaccaccgctttacccaggtccggtctgggtatatccagttcctccctgacggcataggccgccctcaccgtgttcatgaactgggggaacatcagttttccggactcgtacttccttcctgcctcggctatggcgccgtcgatgccctcgagatcggcctcctccaaggacataccttcggaaacggtcctcttcacggcgtccagcgcacctttcatatccatgccgatgacggccttcctgatctcctcgacagacatggggctcctccttctgtgatctggcacatttatctgcgaccgttatcggtctcttaaaacattattttagatgcatgcatagctaacgctgatgcatgcgataaagaaagtcctgccgaacatcactgggatgcgggaccccagaggaaggacaggagcattacgcagaagacggtcgcggccatgacgatggcgagcttcttcccgggcgtgatgacgagtttctttttggtttccatttcaaacacctgccgcgaacggcatatgatgtcgacacctatacatcggagatataaaagtctctcccgaccaagacccattttctttatactgagtaaaccataatgagtagcatggctacttatgttatactccacaccaacatgggagacataaagatcaggatgcacgacgacatgcccatcaccaccggcaatttcgtcaagctcgccaaggagaaattctacgacggcaccatcttccacagggtcatcaacgacttcatgatccagggaggggaccccaccggcaccggcatgggcggacccggatacaccatcgacgacgagttcggacacggacactccaacaagcccggattcgtatccatggccaacaccggacgcccccacagcggaggaagccagttcttcatcaacaccaacgacaacggctacctcgacaaggagaaccccagcaccccctacgcacaccccgtcttcggacaggtcgtcgagggcatggatgtcgtcgacaagatccagaaggtcccgaccaacaggaacgacaagcctctgaaggacgtcgtcatcgagaccgccgaagtcatcgaggggtgatcgaaatgaccggggctgccaagaaggaccgtcatgttttccaagccataggcctcgccaaggtcgtcatcgaggacggaaaagtggtggaggtcggtcagccccggctgaactactgccccctgtacaagaaattcagagggatggaagagatcacccccgaggccatcaaagagaacatagagttccgcatcagggacttcggcctatgcaccgagaacaggaaggtgcgtgcagacgactatgtcaccttcggggtgtcggagatcctcagcacggccctcgccgagaagaagatcgacgcagccgtgatcgccgcagacggctgcggtaccgcaatcatcaccgacccgggccttctgcagggactctgcggaaggatctccggactcatggagacatcgcccctccaagtggtcttggacgccgtaggaagggacaacgtcgtcgatcccgaggagacccccatcgaccagatgaagggcgcggagatggccgacaggaaaggatatgggaagttcgccgtcacagtggcgaggcccaaggatgcggaggccctcagaaaggcctacggcgacaggatcgtggtcgtagcggtacatacgagctgcatcaaccacgaaggggcacagacttatttcgacaactgcgacatcatcaccgcctgcgccaatgcgcctctcaggaaggaggcggagaacagggacatagtggtggcagggaacaaggtcgaggtatacggagtatcggagaccggtaagaagctggtcatcgacaaactcgcctccatcggaaggaagccctatgccggcgagccgttggacgaaccccgcccgttgctctcgtccgagaacgtcatggactatatcgcccacaagcgctgacgaccgtctcaataggtctccaggaccagatgggtgccggaacggagatatatcagaggtatccccgccttcctagccctgcgtctgagttccttgtcgttggtcaggatatatgcgtgttcgcgttccgcaacctctaggacggaatcgtccccgtgggactcggcctgtactatctccctgcttctggcaagggttatggcggccttggcccacttattgtccaagtgcttcaactcccccacgagggggccggggacgacgaaacgtacgtccccgagaaggttacggacctctatatccagattgagtccgacctcaaaaggcatgagtaaggcgtttgtgtccaagactacggtctgcatactgtcactgactgatgatgccgtacccgataagtctccatttgttggagatcctcctcgagatggcgaccctctgattgggcaggatgcacaccgggagcttcagaacgacatccgcatagccctcatgggcgctcttgacgataccgacagtggtggccgtaccgacgctgagcatgagcggctcgttgctcttaatatcgtccacgatgaggtccgcggcggaaccgaccacgcggtccagcaggacggtcttcatcttgaacgaactgaccaccgggggcagcttgccgggtataccgacgacccttccggtgagaccgtccgattttgttatggacggatcgagctccgttccgatggctatgagccctccgggcagaacctccttgacgctcttctcgcctgcttccagggagatgaccttggcggtgatcctctcgtaggacaccttgcctgcggcctccacacgccttccggggaccacctcgatctcgtctccgaccttcagcttaccctgcatgagggaaccgccgatgacccctccgcgaagcttgtcgggagtggtaccgggggagttgatgtcgaaggaacgggccacatgcatgatggggtcgagaccggtgtccttcttgacgttggccacgatgtgtttctcgatggcctcgatcaggaggtcgatgttgacaccgcggttggcggagacggggatgatgggagcgttctcggcgaccgtgcctttgacgaactccttgatctccttgtagttctgcatcgcctgttcgcgggtgacgatatcgatcttgttctgcacgatgactatcttgtcgataccgatgatcgacagggccatcagatgctctttggtctggggctgggggcagcgctcgttggcggccaccaggaggagtgctccgtccatgagggcggctcccgacagcatggtggccatgagcgtttcgtgcccgggggcgtcgacgaacgacacagccctcaggaagtctgtttcggccccgcagttgggacacttcttggaagtgctgtatgcgacggagccttcgcagttgggacacttgtaaaaggcaacatctgcgtacccgagcctgatggagatccctcttttgatctcctcggagtgacggtcggtccactcgccggaaagtgccttggtcaaggtggtctttccgtggtcgacgtgtccgatcatcccgatgttgatctcgggctgcttctgtaccttcattctttcttctcctcaccgtcgccggccaggagctcctcgatgggcttggggccgtactcggtgaccgccatgttgatctggacggtctcggaggagatggtggaaccgcgggctgcgaccctcttcctctctccggggtacctctcatggaagcccagtccgtcggagagaaggagctttaccctcttctttccgggaaggtccgccctcatgggggttccggtcttgtcgctaccgccggtgatcttgagcttgtatccgggaagtccgacgaaaattccgtctacgatctccccgatgtttttaccatccagggagttcgcgtggtgaccagacacggcaacattgtaggatttgccggtcttcacatcgttgacaatagctttgaagtctgccatttgaacacctgtgtgggggtccctaacgagggtccgcttatatatttatcgggatggggaaatgtgccatccttcatggatgccccctctgcggaatgataggctggtgtgacgactatcggtcagcaaggtcgtcgaagtgttttcgacaggatcccggtccatggaattcacagcaccaaaagaccgatattccaattccgtgaaaatatgaggggttgaatgttccaattccgtgaaaatatgaggggttgaatgttccaattccgtgaaaatatgaggggttgaatgttccaattccgtgaaattataagtatgcatacgccgatcatcacgcatgtcggtcaagaatggcatggaaaggaaggcatatgcccatcttctcgagtggaaggaaaccatgcatggttccacggccattcgtttggacggggcacgtcgtgtaggcaagacatatctcgtaaaggaatttgctaaaaacgagtacaaaagctcactatacatcgacttctctctggccgacaggaagatcaaagatatttttgtagagaacgcaagagacctggacctcttattcaacaaactatcgagagcatacggcgtcaccctatacagaagaaagaccctcgtcatattcgatgagatacagacattcccgtttgcaagacagatgataaaacatttcgttgaggacgggaggtacgactatatagagacaggctccctgatatcgatccaatccaacattgaaaacatactcgtaccgtcagaagaacaacagatgtatctgtatccgatggacttcgaggaattcctgaaagccatgggggatggggacctcatcggatatctgcgcgagtgctatgagaaaaagacacctgtaggcaatgcgatacatgcccgggccatggattggttccgtcaatacatgcttgtggggggcatgcctcaagcagtctccgaatatgcgaagagcaaggatttcaaaagggtcgatatcataaagaaacagatcctgaacacctatcgctccgatataacccggttcgccaaaggatataaggaaaaagtcgaggccatattcgacgacatcccctcggaactcagcaagaagaataaaaagttcaagataacggccctcggagagaacgcacgtatgcgtgactatgagaattcattcatgtggctcgcagacggcatgatatcgtcgctatgcttcaatgccagcgatccatcgtccgtcggcctctccatgtatctggaccgccccaccctgaaatgctacatgtgcgacaccgggcttctggtcacccatgcactcatggacagggacggcgccgacaactcattctatcgcgacatactcttggacagactcggtgtgaacgaaggtatgttcatggagaacatagtggcacagatgctccaggcgtccggcaacagattgttctactattatcgcagcgatgcggggaatgcggagaacaacatggaagtggatttccttataagggccgacaggaagatctgtcccattgaagtaaagtcgtcatcatccgattcggtctcctccctgaagaaattccataggaggttcccgaacaccggccagcagatcatcttgtatacaggggatgtgaagacggcggacggcatactgtacctgcccgcgtatatggcaccgttcctctgagaggagatgtgccagatgaggcggatcacattccccagaagggctcagtccttctcttgatggcgaccgtatcggaaagtgccagcttctcgtcgtcggtgagttcgaccttctggacctccttgtatcccgactcgatcatgtcgacgtaaagtacgtcgttctcgttgatctgcctgcctacggtcacaccttcgatggccaccgaaacctcgtccccctggacaccctccttgaggacgtttccgtcgtcgtcgcggacggatttgatggtgccgcagtccttgccctccctgtcgatgaggttctcgcccacacggatccttccggccaggaccctgactcccacgactgcgggcttgttgaccctgaatatgtggtcgggaaggatggtgatcttggcggggaaggcgaattcgaccctcttgtcggactcgttctgcctggtggactcgtccaaccagagcttgtaatcgtcgatgagcgcatagacgatgttgttggtcatcaccttgatgctgtgggtggctatctccgcctccgcatccttggacgtggagacgttgaatcccaggatcacgtgatgcgtatcgttcccgtaggaggattccaggacgtccctgcgggtgatctccccgataccgtacttcctgatgggtatcccggcggccttggcctcgtaggcaagggcctccagggaaccgatggcatcggctttgatggtgatccccttctcctcggtctcgatcttgatggaggtctcctcggtgatctcctggatggacgggtccttggcgttcttcaccacgcgtatgggtgcacctgcgatgacccccgtggcgtcctggacggcgatcttcacaccggcggcggcgtggagttccttcacattgtcgaacctgtccctcggatcgcggatctcgtccaagggcttgggtttcaaaatggcctttatgcgggtgaccaggggtgcacccctggtcccgatggccaccgtggccccggtcttgagcgtccccgagtagaggatcatgtcgagggtctgccccagacccttgacctccttcacctccagcacggtacccttcccgggaccctcctccttggtgagccttgtctcgaggaagcgctgtgccagaccgatgagcatgagcatgaggtcgggtacaccctccccggtcttggcagagatgggtatgagtgccacggccttcgtgaagtcgtcgatcctgtcgtacctgtctgcgaagacgccgttgccggacagctgggagatgatctcgtacatgtgctgctcgaacacctccttggtgtgcgcctgctggtccttctccgagaggacgaacggcctgtcggcggtggagttccagccctcgatggtgtcgaccttgttcagggcgatgacgaagggggtcttgtactgcctgagtatgtggatggactcgatggtctggggcatcagcccctcccttatatcgatgaccagaacggcgaggtccgcgagggatcctcccctggcgcggagggatgtgaaggcctgatggccgggcgtgtcgatgaagagaaggcctggcacagtgaacttcttgctcccgatgatggagccgcacatctcgtatatgcggcctatcggcacctcggtggcaccgatgtgctgggtgatggccccggcctccctgtcgcctacggcggtacccctgatcctgtcgagaagtttcgtcttaccgtgatcgacatgacccagaacgctgactacaggttgccttatcgccataataccatctcacataatgaacatcgagctgaaaatcttaaaatgtttccggggcccgaaggccccttcgactcactcgtagatccacttgtcggaatctctcttgtagtcgacgaggtcttcgggcctgaagaagataccgatctccctggccgcggactcgggggagtcgctgccgtggatgatgttgacgccggtgaccatgcagtagtcgccgcggatggtcccgggagcggactcctgggggttggtcttgcccatgatgttcctgcagacctgcacggcgttctcaccctcccagaccatcgcgaagacgggtccggaggtgatgtaggagatcagggacgggaagaacttcttgtccttgtgctcggcgtagtgcttctcggcggtctccttggggatgaccatgagtttggcggcgacgagcttgagtcccttcttctcgaaacgggacatgatctctccgacgagtccgcgctggaccccgtcgggctttaccatcagataggttctctccatagccatcgggatcactccttgggtgcctgtgccttggcggcggcgttcttcaggcgtgcgtccttctcggagtgcgccttctcggtccaaagggtggtcctggggaccctcttgagctcgatcatgttcttgtagcacttgttggcgtcgaagaacaggacggatccgtccttctttacaaacatcttgccggttccgggagtgatgacctttccgcagaacgagcattttctctcctctaccattcaaatcaccttcccattccgagctttctggcctctctggaggtctctctgagcatcaggacatcgcccattctgacgggacccatgatgttcctggtgatgatccttcccttgtcgcggccgtcgagaacacggaccttgacctgggttgcctctccggtcattccggtgcggccgatgatctcgaccacctcggaggggatgctgtcggtgtcgaccattcaaatccctcagttcttcaggtccttcacggctgctgcgatctcgtcgacctgggcctttccgtttccggcgtcgacgatggcgacggatgcggtgggcttctcgagtccgatcgcctttccgagctcctccttggaggggacgtacacgtaggggacgttcttctcgtcgcagagggcgggcatgtgggcgaggatctcggggggctcgacgtcggtcgccatgatgacgatggccgcctctccgcgctcgacgatcttggtgacctcgttggttcctttcttgacctttccgctgtcccttgcgatctcggcgagggcgtacgctttgtcagaaacttccttgggggtctcgaatttcacgaatactgccatttcaattacctctttcaggtgctctgggcaccatcattattcatcggctccaaaagagcgtatcaggactatcggatggtcatataaaagggttggcaggtggcccgtacggtccggcggaacggatccgatgacaaagtgtaccagctcccgttgaaatttagagactccgtaatcaaagattgtgcaagcctggaattaccagatattatgctctggagcatatgtctcgaggatgtcctccgagacctaaatctgcggtttgtagtactacaacgatgtaaccatacagattgttgattcttctttatatgcggtatttaaagaatatataaagaaaggtattatatatgtaaccttacatataggttactaatgggaagcatattctatatggaacgcaacggccagaagtacgcctacgaaagtacctctgtcagggtaccgggaaggaaaaatccgaaaactatcaagacgtacctgggcagggtggacccggagacgggtaagatcattcctaaagagtcgaggagccgtcccaaggaggaatatgcgaagcattacgggtccgtcaggttccttgacggcatacagaaggacatgggcatcttcgaggacctggatgaggtgttcaccaccttggcacccaacatcatgggtgccgccatggccctggcgatcaatcccacctccatggattcgatccactatacggtggagaacaccgtgatcagggagaccatgaagcttagaggaacattatctccgagcactatgggtaccgtctgcgaggatgtcgggggaatgatgatgtccatggtgtctgagacggagatgaggctggagaacaccaaacaccgcgatcccgaactgacgtacaggaaactgccgccgttcgtaaggaggtatttggactacacggtcgacgatgatgggtacatgcacatcgagaggaagcagaacgcgttcacattcgcagacaacagggccgggatgttcgtgatgctggcttcctcaggtacgacattcgatcagatgatgacctcctacgatgtgagggattgggtggagaaggccttcgacgtatacaagaacgaactggaaggggacaggaacaacaccggcaatccggaacgcgccagaggacggctgttcataaagttcatagcgctgatgatgaggatacgcatccagaatgttttgagggaccacgaccgggatgtgctgcggaccaaggcgaagaaggattctgtcaacgggatgtcggtgagcgaactcctcctgtcgctgaatacggtgttcgccatcggcaacacgggcgactggaggctcacgcacatatcgaagaacatcagagagatattcagcgtcttcggactggagcagatggaatcgggccagatcgttctgggatgatgtaacctatacaatccgcagatttaggtccgagaggagaggaccgacttgtagtgacccgaatagtcaccgatggcgggagtaatacctactacaaaatagagaatttcagctcttaatcagcaatttccgaaaatctgatgaatggcattccacaaaacttacaacatagaatgaacaaatggccacaactgtacacaataacaaaacatctaatccatgaccataaaatacatctggaccacaccactcgcaaattacattaaacacagtaatgtgggtcatgaataacggtagacttatcttgcccagaaatgatatgactcccttacatttaattctaaaaggcaccccactatacagaagagttacaaatattgctatgaggaaaaatatagaaacagattgcggacaataccactttccattgatgaaaaccactattgctaaaaaacacatgatttcgaagaccagaattacagctctaccaaaggttgtaaaattaagtctttgaataaaatttgcaacatcataacaaaccacccctattgccatctccccaatgcctctaatcagaccatagtatactgccccagaagattcccaggtcaacgtaatgtatcccatcttgagttgtaggtagccaaggcaaaatatgccaagaagagggaataaaatcattctggatgcactgttccacttgagataaagcggaaaaaggataaaaagtccaataaccattgcagagatgtaccagaaaattcctggacatattgatgtaccaaaccctgctccagacatcatacataaaaataaatctggaacagaattgactagatcttctgcaattgagacaacatcgccaccataatgaggcaaacaatagaagaagaatgaaacaaccattacaagaatgaggtaaggatagattgccttaattttcttaataataaaataaaccgtagattcgggaatattctcttgcaatttggttaattttttattagcacattgtgccatcaatatgccacttaccaggaagaaaaattcaaccccaaaatgcccgttatgaaacaaatcaaaatcagaaatctgttcaagatgaattccaactatagaaactgcaaagaaaaaacgaagtaattcaatactcccattcttattactttctacagttgatttaatcacgagtttgtaaaataaaatatctcattatttaaacattttgaatgcaccgtagaatttaaccttgtaagtccgatgaagaatggagagatcttctttgaaattaaactcctacatcactccagtttcttcaactcctcccttatcctcgatttgatgtcggtgatggggtccacgttgcaggggtctatgccgtggagggcggcgatgtagagggagatgtggtcgccgaccatgatcccgtagatcatcctctccagaagggactcgcccttggtgtctatgacggacacggggacgtccctgctctccaggaggtccagcgtggccttgaggatcttgctgatctccaccagcctgtcgtcgcagatgacgaccggcatgaacttggtcctgtaggggtcgtcgtaccatccgacgacctcgttgtggttgaactcggggacgacgccggagaaggcgatgatcttggagttctcgttgagctggttcttcatgcggacggcgatggcctccatgtcgggggcgccgtacacgacggggacgtggccctccaggtccttcgcgatcctccaggcgatgccgtcctcggactcgatctccctctgataccccctgaggcgggggagcatcatcctcagctggtgccttataccgggaccgccggcgtcctcgatgatggcgccgaggatgcctatgaaccagccgatggcgctgcggggctgcatgtccttccctttgatggggactatcggcgtaccgatctcctcggaaagcttcctgagtttaccgccgtgggtcacggttatgacgtcgagacctgcatcgagcgcgagcttgtacatgaagatggtctcgtaggtctctccggagtagctgcaggccacgaagagggtgtccttgtccacccactcggggagggccatggtcttgcaggagtcgacggagaccttggaggagtagtacatggaatcggcgaatatcgcaccacctatggcggaagcacccatgccgcagaccatgacgtgcttgtagcgtctcctcacgtgggtctccgactcgagggcctcggcgagatcgtcggtgaatccggagatctccctcgacatggtgttgagagaatgggtgtcaaataacattgaatgcctcaaagagtaacaacaattgtaagattatatattttgacatatgctttaaacattctaaacatctttccaatattttcagaatgaacaaatctcatatcttgttcttcaaaaacgatgtaaactaatttttatacaagtgcaccttaagatgctcgaatgttcgaatttatcagggaactgtatcaatatcattctatgatcctgaatcttgtcaagagggatctaagaggaagatacaagggctctcttcttggatttttatggaattttgtattaccattaatgcaaatattggtttacataatggtattcaccatagtttttagacaaaatatcgaacattactatgtttatttgatagtgggcatgattccttggattatgttttctgaatccataaacagtggctctggctcagttgtagagaactctcaactgattactaagatatattttcctcgctcagtaatccccgtatcgatagtcatatcaaaattcataaatttcctcatatccatgactattgtattcgcagtattggcaataggaggacatgggttcagcacaggccctttattgctaataccaatcgcaatagcgtgcctatttatgttttcactagggttggcagtattgctagcagcagccgacgtgtatcttagagacgtacaatatttgataaatgtgctactgatgatgtggatatggattacgccgatcatgtatgtgcctgactccattgacagtgcgattttcaatcttatcctcgatatcaatcccatgacatacataatcgaactattccaagatgcactatattggaaaatcataccatcttttgaaatcattatgatatctgccatagaatctatagtgatggtcgttataggtttctggatatatcagaaagcatcggcagatttcgcagaggtgttatgatactgcctgaaaatgtcattgaggtcaagaatgtatgtaaaatctatggaacacatagatctctgtctttgaaggaccgcatagtgtatcatgcttccaaaaagaacaacaaaggcagagaagtactacatgacatctcatttaatgtaaaaaaaggtgaagccctgggaattgtcggacgcaatggatcaggcaaaagcaccatactgaaacttttaactaaaattatccgcccgaacaaaggtaccgttgaaacaaaaggaagaatatcttgccttattgaattgggtgcaggatttcacccagacatgtctggtcgcgagaacatatacataaatgcatctatttttggactggataaaaaagaggttgacaagcgcattcaagacatactggatttttctgaaatcgaagatcacatagacgaacgcgtaagggactattcctctggaatgtatatgagattggcattctccattgcaattaacgttaacgcagatattctaatcattgatgaaatattgtctgtaggagatatcgctttccagaaaaaatgcctcgataagataaaagaactaaagaaaagcggcgtgacaatagtcctggtcactcaatcacctgaacaggcgatgaaaatctgtgatcggacactatggatagataatgcacatacacgcatgattggcgatagcaaaaccgtttgtgatgcatatagcaaattcatgctcgaatgatggatgtaggggctccgaccaaaaatcatattccgaattcttgagcaaacaactcaatcatccgtctgcgggaataattctctgatacatatctcgaataggaccccccaagtgccttggcatattcacaatcagagagtatacgtatcacttccgccgcgaattcctctgctgtctcttttggagaaatgtacttatcaatcccctgcatgccttctatgcctattgatgtagaaacaatggggattgaattgtgcatcgcctccaatgtcttccctttgacaccagctccaaaacgtaaaggaatcacacaaaccgaagatgtagagtacaactgattcaattcatcgtctgaaacatgattgtgaaaaataacactttcagaagacagtttgataaggctatcggttgcattagaacctatgatatttatcctcgcatcaggcacctcttttttaatcaaggggaaaatcccatctaaaaaccaatgcattgcatccctgttgggcggatgattaaaacttccaacaaaaatcaaatcatgctgaccgccatatgatctattgacagcgttgcaatcatcatagcaaaatatgggatatatgcgtattttcgacgcatccacgatgccagacattatcttggcctcatccgaactgacagtcacgcatctgtcagcactattcagtaattttgattcaatcttttgatacctcaaggactcttgcagataggcacgattgcccgtgacatcatattcccttcttaaacggacatagtggagatctgctacgttgtacagaacagtggcagaagaattgtccttaatatatttcataaaaaatttggcacaatcgggacggaaaaccatgacataatcgatattagaggaattgttctttatccaagacctccactcatttgcatatttatgaccatatagtacctcgatacccatggattcatagatggggacatactgcggatcataacagaagttctccggcataaatttcacattacagcccatagacacaagtgtcctcatgtaatcataaacagtcctgttgcctgcattatcatcaaatctagggactgcggaatcgatgaacagaaatgttttcttgttgaaactgcgatcccttgcgtggaatagatcagtttcagaaaacttgtggaaattatcaagctctgaagcccatttctctctgaatttcataacattggaaatctgatacgatttcatctcagatttgaccgtctttccattagatatcccctcaaaatgtataagctctgatcttggctgaaatactgttctatacccaagttttctaatcgaaaatgccaaatcactatcttcgcaatatgcaggtttaaaacgttcgtcaaatcccccaagcttttcgaaaatgagacgaggcaccagtatcgatgcccccgttatataatcgacatctttaacataattaaattcaggaaggctcggattggaacctctcccataattccatgcactaccgtctgagcgaattatccctccggcctcttgcagactaccgtctggataaataaacttagatccgacaagaccgatactggaatccgactctgccaattcaacaagagcactaagccaattttcctttaccaacgtatcattgtttaaaaacaacaggtattttccctttgcaaacttagcagcattgttacaattaagaaggaatcccagattggttttattatgaactactttcaaattacgtatgcgattttctaaatcctttgtatcatctgaggagttatcatcaccaacaataatctcaatattgatatcgccacgatacttgattatagaatttatacacgcaatagtgtaagaatactgattgtacactggcaaaattattgaaacgagtggaacatgacactcgggtacagattctggacagttgtggtccatattggattttacaaaatcaagatcgttttgagtagtgttgccagagtaattggacatcatgcgaattgtatttgtaactgcaacactaagtccatcccacctccacactctaaaaaaagtacggatgttataactattgagtatttggtataatgtagacgggtgttgaataatattttttgaaactgttaaaattatacccatctgatttttttccaatctcacatccgccaccgcatcacttgactagggtcatttctttaatatacctgttgacagcatctttccaatttggtaacctgtcaaacccatttacttccaaagattgaagaccaagtctacaatttagaggccgttttacatcagaacgataatcattcgagctaatggggattacattggtccccgtcccgagtattttgaacacttcgatggctaaatcgtaccatgtgcagaatccctcattgtgtgcatgataagttccatatttttcactacatagaatctgccatagcagaggggctaagtctacagaatatgttggagatccgaattgatcgtcgacaactctgattgttttaaactttttagataagtccaccatggtcgcaataaaatttttcccattaataccgaaaacccaagatgtacgcacaataaaatatttcttcaaggaccgaactatattctctccatctcttttactcaatccgtattgatttatcggattggtacgatcagttatctcccagggtctaaccccagacccatcaaaaacataatccgtactgacataaagcattgtgatatcgtaatctttgcagcaatctacaataaatctggtcccatccacatttacctgcctgcacagattcacattcacttctgctttgtttacatcagtccatgcaccacagtgaattatcgaatcagggttgttttccataatgtaggattttacagaaccttcatcggacagatccatttcattccgattgggtgataaaaaatcacatccaactcctctcaaataccttgccacgtcgtaaccgagttgacctgtgactcctgttatcaacacagtcatctaaaaggcacctcggaattagatttgagatagctaccatcagtgatacgatctaaccaacgacaattgtcgatataccactgtattgtcatctctatgcctgtttcaaaactaaactccggcacccagccaagatctctgcgtatcttggaagaatcgattgcataccgcctatcatgacccttgcgatcatcaacgaactctatcagagactcaggtttttctaaatatgacaagattaactttacgacatcaatattcttcttctcattgtttccccctacgttatagatctctccctccctcccatgacgtaatatcatatccactgccctgcagtgatcatagacatatagccaatccctgacattacgtccatcgccatacactggaagttttttattgcaaagggcacgctttaccattagaggaatgagtttttcaggaaactgatatggaccatagttgtttgagcaccgagatatagtaagtggcaagccatatgtgcggcgatatgccatcgctaacaagtcagcccctgcttttgatgatgaatatgggctagacgtatgaaggggcgtatcttcattgaaaagtaaatctggccggtccaaaggtaaatccccgtatacttcgtcagtagatacttggtggaatctttcaaccccgtacttgacggccgcatccattaaaacagaagttcccactatgtttgtttcgagaaatacctgagggcaagatatggatttgtctacatgggattctgctgcaaaatttacaatatagtctggcgatatactctcaataatgctgtaaatagctttgcgattacatatatctgcccgaaaaaactcaaaacgatccgacccactgattgaacccaatgtctcaatattaccggcatatgtcaaagaatctatacatacgattttgtcgtgactatgttttttctgagtgtaaaaaataaaatttgatccaataaaaccagccccgccagtgacaactatcgttttagacatatgaatccccccgacataattcattcagcctagggtatgccttatctttttccgaaagaatagggctttcgaccaagggccaatttatgcctatgtcgggatcatcccaagcaatgccggcctcgtcagaaggatgataaaaatcatcacatttgtagcaaaatattgcagtatcgcttaaaactaaaaaaccgtgagcaaaccctttgggaattaacaactgcctattattgtctgcagaaagaactgttccaaaccacttaccataagttggacttccacaacgaatatccactgcaacatcaaatacagacccatccaacaccctaaccaatttagtctgaggaaaattcatctgaaaatgcagccctctgagaacgcctctggacgattttgattgattgtcttgaacaaaattgtaatgcagaccgagttcttcaaaatcttttttattgtatgattcgaaaaagtaccctctgctgtcgaaaaacaattttggttctataacaagaagatctttgattcctgtttcaattatcgttatttttctcattcgactttccttcggcaatttttttcaaataagccccgtatggtgaatttccataacgaacagatagtgccagcattttctccttggagatccaatcttgattgaatgccacctgttctggagagtttatagtgtatcccgtccttacatagtggtcatgaacataatctgatgcttctataaggctatcaaatgttcccgtatcccaccatttgaacgatttgtccaataaatttaccttaagtgatttttttttgagatatatccgattgagatccgtaatctctagctcgttgcgtttagacggtacaattgtttttgaataatctacaacattcttatcgtagaaatacaaacctgtgacgcaatagtcagattttgggcaaactggcttttcctcaatacctattacattgccttcggaatcgaattcaaccacaccaaacctctgcggattctttacaggatatccaaatattgtagatttcccacgttcggcatctatgactgcctccctcaacatgtgattaaaatcattcccatgaaaaagattatcgcccagaatcaatgcacaagcatcgccttctatgaatttctcgccaattatgaatgcctgcgcaagaccatcgggagagggctgaacctcgtaagatatcttgattccaaaatccgacccatctccaagaagctgtttgaatttacctatatcggagggtgtagaaattatcagaatatcccttatgcctgcctccataagaactgaaagaggataaaacaccataggcttatcataaaccggcaacagctgtttagatgtagatactgtaagtggatacagtctagttcctgaccccccggcaagaacaatccctttcatcagattatcattatggattcattatatgtatttaatccgatacctacatcattgttaaattgatcaaaaatgaaaaattgaaagatattttgcaataatcgattggagacaaataaaatatcaaaaattcactgcgagtaataacatgattcgatttcgataacgaattacaacaattcagaatgtaaacgtctttccatagactgagaagtttcctccgagatatatgaagactactctattcccagatacttctgaaaccctctcaaaggtaccggaaatcgtttccctcgttaccttgccagaattgtgctcgatttcaatggaacaataacaaagacctgatgccacaacagtagccaaatccatgcgctgctcattagaataatctcccgccaccacacatatcattcctgcccctttctctacgaatgctatgctcgaatatgtcccgtccgtataccctatggcaaggttcctgacagccagcaaagatgtatccacaccatataacacccgattgtttttcagggacagatgatcggcatactcatttccactggccgatatgaccccatctgcaactccgaccctgccaccctcatcattaatcgcaggattcaaacagttcacaccaaaaaacaaggattggtagtctccggaaaattctgtaactctgccatccgaatgcgccacatacttaccgatcatacctcctgcccaatacaaactgcccccggcgacaatccaatctatgaggagggtagatgactccccatacatcacatcaggtatggctccagccaagattacgacacctttaccgacggccgaccctgtatccctcaacaaggtcgcaagtgtgtctgcatccattgtcgttaccggcacaccatagtacttcagattgtttgtcaactgagaaacatagtattcttgatccaactgcctagatcccgtctctatagtagtgtcattaaaaacagaaccatagcgatcgtcataaaacagatatatcgaatcaggcacctcaaaaccaccattatccgtaaggattgcatcgtatacatgagacccagaatcggatatactgtaactgccatccccatatgcgctggcactgtaattgtaggggtgggaatatgtaacaacttcccccaccacgaccatcagtatgatgatcagtgatgtcacaatcacacacatgcccttaggcaccttcatcattacacctcgtcaggaccgtccttaccttaaccagaacggaacggaactttgcaaatcttttcccatcataatcctcctcccacatgaatagaagaagcagaatgatggtgactctctggacaatattcaacagagatatgatctgcgcttgtacagtactgtcaaacaaagccatatcaagcatttccatggcatttattaaagaagtcacgtcccacatgccatagtattcgacagctgttgtaagcaaagacaggctattgttcataaaacctgccaacatagcgatgatccctatgactatgaaccctatcttataatgtctattccctataactgcaaaatacgcaagcaatggaaggaatgttatactgtattgcggacctattctcatcaacacagatgctgctagaatcgcaagagagtagaagaatagtttctgttttactgtttctccagaccccttatacatcctgatcgcagtatagatcattacgaatagaagtgctaagatttcgatcgtcttagaagaccactcaagaagacttgattcactcatacgatcagaaacaaacgtgaaatcattcgccaatgttccatccaatacctgtggaaacaccatcaatgcgaacataaaggccgcaccaatcacgccttcagttagtttgacatactttttaccgtcattctcatgaactttgataacataaatacaaaataatatcgccaaaaatgctggaaagaacttagtcaatgccgcaagagccaacatagcacctgccaaaaaacaacggtcatttctcaagagtaaaagactcaggatagtcacaagggcacaaatacaatcgaacgtagcctgcacagacgacatatatatgactactggacacaggaaccagagaccgaacccggccgttgccttcctgacgtcttccgtatcgtgcataatcaaccgatacaacaaatatcctacgacaacatccacgattaccaacggaattttaatcgcacaattgaatgcagggctggtcgtagtcgcagtatagaatatgttatggagtccctcgataccaaaaagatctgcgaacctactcccatattcccctatggtcaagaaagagttcaaaaagaacgaccccaaattcaaaagatatccccacacaggcgtgtagaaatacccagtaagaccaaataatgcattcccactctcagaattctgcattatgatggcccagtgctctatatcgtaagggtatgtaaaaaatggaattagtgcaaaacgtattgccagacctaaaacaaggatagacagaaaagtaccagacggaaaaccgatagccgaatgggttgccctgatacccttaaagaccatgtccaacattatatgactaggatatttaattaaacgtattttgacaatagcatgtgccgagtttaactcattgggcttgactatattgtgtaaagctgtgaaaaagataaagctaaaaatcctggtaacttaggattaataatttaatatcatgggaatgttgcactggatgatacgatgtcggatatcgagataacggttgggatctgcgcatacaatgaagcacagatcatagaaagggccatcaggtccatcttctcccagaaactatccggcatagtcgtaaaagaagttctggtcgtatctagtggtagcaccgacgacacggatgaaatcgtaacaaaactgattccggaatttcctcccctcagattgttccgtcaggaaaaaagggaaggaaagaactctgccatcaactgttacctcgacaacaagacctgcgacatagtcgtcatgctgaatgcagacaacgtgttcgggacagatgattcattgcagaaactagtggaacctttccgcgatccaaaggtcggaatcacaggcggacgccccatacccaccaatgacaaaaaggacaaaataggattcgccgtccacatgatgtggtgtatgcatcacgagctggcactggtgcatccaaagatcggggagcttatcgcattcagggacataggcacccgtcttcccacagatatgcaatcagatgaggacatcatccggatgaaactggaacaggccggttacatatgtgtgtatgtaggggacagcataatactcaacaggggtccggagacccttgaggatttcatgaaacagaggatccgcgtcaacatcggtgaatgcaccatgaaaaagatgtataattacgacatcccgacatggaatacaaaatatctgattcatgcactgtatgacagcatacatgaacttggattccacccttacaagatgttgtacgtcgccatgctggaacgtaaatgcagacgtatcgcccaagaacatgtagacaaaggtgaagacaatatgagcatctgggatcgcgtagattccaccaaaaaactatgaacaagaaacaggagtggaataatgtcgtttatcaacagcctgttctatggaaaacatggggaagggatacgctacctgttcataggcggtctgaatgtaatcatcacctggattatctatgccgcattcgtgcttgtaggcataggtccctccataagtaacgcattttcatggattgtaggagtggccgtcgcatttatcctaaacaaagtattcgttttcaacagtaagactcatgagaaaaaggaagtcagcagagaagtggcatcttttactttaggcagagtgttcactggcatagtaaacattctggggttcgcactcctgtatgatgtgggcataaatcaggaactgttcggaatagatgggttcttcgcaaaaatcataatctctgcaatagaaattatactgaattatgtgataagcaaatatctggtattcatagacaaaaaataacagaacttccaagtaagtccgggttatagatatatccgtttcaaccagatgacatacctttgtaatcaaaacatctggcatattccaggtagtatcctccgaaatatatgtatacagaatatctagcactattatctactgccatcggtacgatgcctgtctccgtccctctagtaacctcgccgctatctgaacccacgaggaccgaactatagcatatatgcgatgctacaatctgcaccaaatcagcacgttgattgttggaataatcccctccgaccacgcatatcattcccgaaccatattgtgcaagaaccgcactcgcataacttccgtcggaatatccgaccataagatgcggtaccgacagcgcgtccgcattcagcgaataccgtatcgaattgctcatcaaagatagggcgtggagatattcgttatccgagatttccccatacgccttctccgtgtccgagctattgaggctccccggtccgaaaaagagaacctcgtatccgtcgacagagactactccgttcaccgtagaaacatacgcacccagaagattcccagcccagtacagctttcctccggcatcgatccactagatgattggatccgccacattcccggaatacacagtatcgggaaaggccccggacacgacaatcagtgctttgaatctctcgccaccactcaggaccatatctctaagttccgaagcattcagcactttggcgcagatacctctgttctccaactgacacagcatctgggacacatagtattcctggttaagctccttccctccggtggcatgccagacgtcttcaataacgtctgcataattatcgtcgtaatatacataatactccttggccgcgggaaaatccccattatagcttacgaccacatcatatatgctggagatgccggagcccacccgatagcctgcaccgctatcagacatggatgagcgggcactgtatgtcgaatccctatcaaatgtgtatatgtacgcctcccctgcgagtatgaccgcgactatcaggactgaggcaatcaggatatatcgatcatgtctcatctgacgacctcctttctgaatgagaggcgcctaatcttctcgatatatttttccgccttcggacatttcctgaccaagacatcctcgtaatggaacacaaatatcaggatgaggcctgcccccatgaacgcataaccgacactgttcattatcgacctgaaactgttggttccaaaaagatatgcctctgtccaatcgaatccgctcaatatcacatcatacggcggccatcccagatacacactggaactcatgaggagagaataattgttgagtacgaatgcgctaaggaatgctccgaaccctatgagtgcccagcaaaccacatatgagcggtcgtaactgcatatgagaatcacaaggaacggcaacagaacaatgacatactgcggaccaatgttcatgaacatagatattgtaaggaccagcaaagtgtatatcaggaatttacggtcgatgtcttccttggtcctatacatcatatggcccatgaatatcatgaatggcagggcgataagtatcccgcccatgctgaatatagtatcgaggttcagagtgaatccgccggcacggtcggagatgaatgtaatggagtcggccacattcccttcgattatgttggggagcaaaattatgaagaaacataaaagggcacccgtcacagcaagtgccagattcctcttcgccaatccgtcgcacctatgtctggctaacacgagacctatgaagacgaacaccaccgaaccagggaacagttttagaagggtcgaaagtgctaacatgaaccctccagagaaataatgccctttcaacaccagcaatatactcagaagaatcagcaatgcagagaatgaatcgaacatcccctggacgcttgacatgtagactactatggggcataggaaccacagtgcaaatgccagacctccttttctcctgtcgcctgtccaatcccccacgaaacgatacaagatgtaccctacgagaagatcacaaagaattatcggaatcttcatcagagcattgaactccggggatgtcacagtggcgacatgccgcatgttctccagatcctcgactgtaagaagccccgatacgtgggtccccaactcgctgaccgacaggaacgtgttagagaacatatcgataaatcccattatatagccccatacgggagtataatagtatccgaacagctcatagagaccgttcccggaatctatgttctggattatcacagcccaatgatatgtgtcgtaatcatatgtaaaagggatgcagagacacctgatcaaaatgcctgagaccaatgcgataaagagtgtactcttaatccacccagatctctcaaaaaaagatgtgccggcatcagtatatgctcccatttgagatcaccgctctatcgctctccgtatgaatcctggtagaaaatgcaatatcattcccttttcttctttgttgaaaaggaaacgcataacgattatgaaatatatgatgaaggccgccacgaatgcaaaaataacggagacccatcttgtggagatgacgtagacactattgaataggcatccgatgaccaacactatggcgaacatcgcatgactgtaaagaaggggggtaagatactgcagtttcttggtcttggtcagtttcgagcagtacaacggatagaacaccaccttcagaaggaacatcgaaacagcccaacatgcacatgcgcccaacatccccaaatcggtaaaggtcagaactacgaggcacattgccacattcagaatgccgaaggctgcggtggcaaaagccacgggcctcatcttcacatagacgatgggaactgtgagaaggactctgatggtacagaacgatatctccatgggaagcatgatgtacagcatatcgtagaggttctcgtacccaggacccagccacagctccagtatctgtggcatgaacaatatgatgaatgccacgggaaacgccatcaccatgccggtgaacttcatgaaaaaggtcatcgtgtctaccaggcctttccgatccctgttggcgaaataacgatatgccagagggacggataccgctgccagggaagacgttgcagtattgatcatggagatcatgtttgctacaatagagaatgatgcctgttctgcagcgcctaagcatacatttacaattatcaaagatgcctcgatatacatcagcgtaccgaaatcactgagtgttgcccacatgccgagggcggacatctctttcagcatactcctgtcataattcttccttgagagttcgatctggggacagactttcttgacatagaccgccatgatcagtatcatgagcaccgatgcgatgacatacgatgctcccagcaggggcaatgatgccccatgcatgacgaagaacaatatgaccaataccacctgggcaacgcaatacaccgtcttgctggcatatatgatgtataacttgttgtatgccatgaagacactgcccagacatgcgctgaacgagatcaggagcgaggacagaaggatcatggcgaacatgatctgcacatccaaggcggcagaaccggcgacgttgaagacataaggggatgccaaagagatcagcaccaccaacgggatcagtacagccatacacctcatcatacctaacatggatgagctgtaggtcctgttggcgagccccatgtcattcttctggatggctatcgacgtataccttgcgaaggcatctcccagaggatccgttatggcaaggacatagctggagatggatgtcgccagcggaaggatggcataggtggccaacccgaactggtcgatgtaatacggaaccatcaggaacccgaacaatgccattacaacagtgcgcaggatgttaatggccatattgtaggagaccttgctggagaactgatcctcatcctttgttcccttctgctttgccagacctcccacctccgaacaatctgttcaggtacctgccgtatgccatgagcaatacgaccagtatgcctgcatattgaagaatgcttccgatgacgaactcgatgttccagaccgtgaatacgccggccccggaattccagatgtcgaagaaatgttccaaggaactaatctcgataagtcccgtggataccgccaaaggcaaaaggtgtgtcgaaagggacaccatgaatactatcgtcgcccctatcgcaagaagtttccaacaacggatatacttgtggttctccgcagcgatgtaatatgccagaagagggacgaggactacgatgtactgcgtggcgggagggtatagcaggcacagggccaagacgatcatggatcctctgagcaatgccttctccagattgtccgcatccgtgcgatatatacttctggctacgagtgcggatgctatgatcaccaggacatatgcgaggatacgtgtgtaacccatgagttttgaaagaagggtactctccgccgaagtgccggagcggtcggtaaggaattggaagcaggcggacaggtcgcccgccatgatctgcggcaggaatatgaccgccatgacggatatggcccctatggcggccatgactacttgcgtataccctttcctgcggtcgtccctgtttctggcaagtacataaaccaccagcgggaagaacaggaacacggggaagaatttcgtcaatacggccatggcgaagcacatccccgccaacaaagacctgttcttgatcaccagcagcagagacagcatcatgaacgtggcggccaaggtatccggcataccgattattcccgtggaaccgattatgaccgggcagaggaagacgagtgcgaaagcaagtgtcgccttcttcctgtcatgcttaagctcatccacgagaacgtacgtcagatatgccaggatgacatcgcatatgaggaggggcagttttgtacagtagttaaagaccaaggatgtgaccgttgcactggtctgatgaccgcttgcctcgaagtagatgacgtcgaatacccttacggcggaatcccccagactcaagcacgcattctgaaacgcactgactaatcccaggatgtatccccatacaggcgtgtaatagtagccctccatgccatagagcccttcgccagcgtttatgttcctgatgactatggcccaataatccgaatcatagaccatggccaacagcattatcagaagatgtatcgcaagccccgcgatcactatggcggcgagaggatgtcttatcctgcatatgtgtccccttatcttgtcgatacatggccactcatgcatggaaacacgctccgaaattggcgtaggccccgcccgtgtatatgaatagatatgtgtcagatgtcgataggccgaaagaacccctgacggtctccctggtgaccttatccttctgcatacttatgaaaacactgtcgcaggtcagtttggaggcgatgacctgtccgacgtcatccaattgatttatatcgaacccgcctgcgaaaacgcagaccataccgctcccgacagacaccaaggatatgctggcatacccgccctctccgaaacccagctgtatcccggaaagccccgtgatgtctattccgaattcggtcgtactgttcttcagacagagggcttcggtgaaaactccaccgaccggattgcccgttatgtatccgagttcatccttatcgtcgcaatcgaccggaacggatgtgccgaagaaatatgctgtacagtcccccgacaccttgtgaagaccgtcatcgtcggtgtagaatctccctatctcggagctcagccaatacaagcctcctccaccgttcacccaattgaccagaagacaatcggactgaccggagtacacggaaccggggaccgcataggacaacaccatgatgccgatacctgcggaagacgacatggtcgatctgagaatttcctccaactcgatcccgtcgataagggtcacgtccgtgaacccgcgtatcttcagagactccctcacctgttcggcataatatccggcctcgatgtaacagggtttggcaccgtccgacaggtcgcatgcgtctctgtagtacttgtcataggtgccgtccacatagatgtacaacttactcaccggaacctgccctgcattgtcgaaaagcacggcacgatactcgtccgaaccggaggacttcacggaataggacaccttgtccgactcccatgaggcggaagcatcgcggtcgacctcgtaaccgtaggtaaggtactcccctacgaagaccgccgcaatcaaaaccacggccagaactgcgattttatcggtttttgacaccataggttccgcctgtttcgaagaccttaggtttcttagctaatactctttcttatatctaccttaagtccgatatatcaaacgactgcacgcctatagtattttcaatcaccaatccattcatcctttgaaaagaaagaccgcaacaggtccagaaacccaggtgcaatcatgctttatgtagatccatatgtaaaaaataccttccgtaaaagtcagcccgaaggcaggaagaccttcatcagactcgatcagaatgagaatcctgacggccttccgaaatggttcttcgataaggtgatgaaggagataactcccgaaaccctttcgatgtatccggaggagggcgtacttgttgaaaaatacgcggacatgatcggcgtaaaaccgacaaacgtcacgctcaccgatggcagcctcattggcatgggctatctgatccatgtattcgggaaacctgggaagaaccttgtcgtggtaaaaccgacattcaacatgtacggtgtattcggcagtctgaacggcatgaatactgttgaagtcccctacgagaaagactttacaatgcccatcgagaagatcatggacgccatcgatgaaaatacgggtatcgtggttctcgtaaaccccaatatgcctgtaggaaacacctatgagcaggatgagatagagagggtcatccaaaaagcggccaaatatgatgccttggtcatagtagacgaggcataccattacttctatgacggcacatcgataccatttatcgataagtatgaaaatgtagcggtccttaggactttctccaaaatgctggccataactgccctcaggctaggagcggtcatctctaacgagaacatcatccactacgtcaacaattggagaccgcactatacgatcaatgcggtgacgttgaaattcggagagatgatcgtcgacgagcatgaaaaacttcttgcggagttgagtgctaacttcaaggagggcaaggaatacatcacgaagcgtctcggtgcggaaaactatgacatcatacccagcaacggatgtttcatgtgcatacgtctgcgccataggaccggggaatacgtcactgccgaattgaagaagaggaacatcctgatcctctgcggcacagggcccttggaagggtatatccgcctatcggtctgcggaaaaaaatacatggaaatattcgcagatgcacttctcgatatagatcaagagtgatcaaatgaaaaccgtggcactcattctggcaggaggcataggaaaacgtatgggtgtctctcttccaaaacaatttttggaaatcaaaggaaaacccgtactcgtacacaccctttccaatttccaaagaaacgattcggtaaattcgatagttgtcgtatgcgtatcggattggatagaatacacttgggatctggtcaagaaatacaacctatccaaggtcgaagcgatcatccccggaggcgacacatcgcatgattcgactcgtaacgggatattccatctgcgcagaaccttaggcaaaggcgatgtggtaataatacatgatgcggcaagaccgatacttccacagaaggccattgatgagatgctccgcatagccaaagataatggaaacgcttccttggctattccatgttacgagaccgtgatatataccgacgatcaactgtctggaaacaaagaactcgatagaagtcatttgatgagggtacaaaccccgcaagcatacgaatattcgagcatattggaattatacgaacgtgcggagaaagaagatcgtcacgacttcatatatgcagacatcgtcgccgtagaatacggaatgaccgtttatttctccaaaggattcaccaacaatatcaagattacaaaacaggaggacattcccctctgcgagtacctcatggatattcccgaagaccagctgttcgatctttgaatatcaactctttcacagagtcggactcctcacaataggcctccactgcataggccattcctatgaataatccacattccacgactccggggataacatcaatagctgactctaaagctacgggatcggatatactcttgaatctacagtcgtaaatatagttgccaccgtctgaaacgaatgccttcccatccccattggttctgagaagaggttcgcatccgagactgctcagagcagaggcagtcttagaatgggcaaatctacatacttccacgggaagagggaccttttttccaagaacgtccgtgactttgaacccatccacgactatgatctccttctcagtcaaacttgctacaatcttctccctcagaagtgcaccaccaagacctttgatcatatttagatcggggtccacttcgtcggcaccgtctattgtgacatcaatgtgatccacctggtcaatatccgatatctccaacccatgcatctgagcataagaagcagtctgcaaagaggttgctacaaatttcaaatcgtacccttcatcgaccaactcggcaatacggtctatggccatattagccgcattgccagtacctagtccgatggtcattccgtctctgacataatcgtctactgctttttctgctgcagggcgctttttcatccaaggcaaaacatcggacacgttatcaacccctatcgatagtgtagtccttgaacacattaagagggaatcccttggagcccgtacgtttatcctctggtgggggagtcatatagtccccgaatatatgtgtaagtaactcatcatttttctcggcaagataacaggtcgtatcctcgaaaacatggggcacaggacttccgaaacaatctgacgggaatatctcattttgaaattcggtcgtatatatcgttctgaaatccgacgaatcttccaccagcatctccgcaaacttcctgaataaagaagggacccataaaaacgcgcgatagacgccgaccgattccagatgatccaataaggtcaccgagatgtgtatcccccatatcgagatattggacaacaatcttctgaatcttccaaaaggatatctcaccaagggaaacagatctatgaaaggagcatcctttctttcgagatctttttcaaaatcatctccgcgatatatgacatggggatgtgtgtccgccttagaatcatggtaatagtagtgcttgggatccaactccgactgcagatattttttgatatcggcgagatcctcttgccatacccagatatccatatcgtcatcccaaggaatgaatccgccatgccttacagctccgatggcagaaccgtagcacagataatacctaatcccgtgggcatccaatatcttagagatgtccttatacatagaaagaagacgggattgagtttcattcatcatttccagagaggacatgattcgatttatattattatactacgtcgaacgtcaacatggcactacgttcatgatgtctcagaatcatatcatctagaaggttaccagaaataatcttgaaccatgctagtttcccgctattttgtctgcgaccaagacatgtctatattggattccaaaatccctatgtaaactgaagtctttgaaaggattgtcatccatatcgttagtcaacagtatgaagtaaatgtaaatagactctcgaggtgtaaaataagtgaagaaggaacacaaccacctccatttcggaaccgtacatggtagttttccaccatgtggcagtttaaatgtaatgcttaaactacattattgtagcctaaatctgcggtttgtagtactacaacgatgtaaccatacagattgttgattcttctttatatacggtatttaaagaatatataaagaaaggtattatatatgtaaccttacatataggttactaatgggaagcatattctatatggaacgcaacggccagaagtacgcctacgaaagtacctctgtcagggtaccgggaaggaaaaatccgaaaactatcaagacgtacctgggcagggtggacccggagacgggtaagatcattcctaaagagtcgaggagccgtcccaaggaggaatatgcgaagcattacgggtccgtcaggttccttgacggcatacagaaggacatgggcatcttcgaggacctggatgaggtgttcaccaccttggcacccaacatcatgggtgccgccatggccctggcgatcaatcccacctccatggattcgatccactatacggtggagaacaccgtgatcagggagaccatgaagcttagaggaacattatctccgagcactatgggtaccgtctgcgaggatgtcgggggaatgattaacaccatggacagattcttcacgagacgcatagccagatcctccagcgggttcttctccctcgatttgacatcggtatcagcctattccaagatggggggatgggcacagtggggacacaaccgcgacggagaggatctgaaacagaccaacatagccatggtcaccgatggcgatgggattccggtcatgttccgtatgctccccgggagcattgctgacatggcggtgatgaaggacaccgtccgtgatatgaaggacatgggctgcaagggaaggatggtcatggacagaggattcgagagtgcgaccaacgtatccgctctgatggatctggatatggatttcaccatgccttcgaacgtgaaagctgagccgatcaagaagctgatgtccaaagcgatagacgaactgaaggcatcgtcctcgttcgcctttccacgaggggaaggcgtacaagtatgcggagtatgaggttggggtgatcgataccgaagacggatacgggtatatcgtcgaggtccccaggaaccacagggattctgccgcagtgaacgagagattcgcaaaagccaggaaactgaaggcattcgtggtgttcgatccctcgaaggcatccgacgacatcacgaagatgatgtccatggtgtctgagacggagatgaggctggagaacaccaaacaccgcgatcccgaactgacgtacaggaaactgccgccgttcgtaaggaggtatttggactacacggtcgacgatgatgggtacatgcacatcgagaggaagcagaacgcgttcacattcgcagacaacagggccgggatgttcgtgatgctggcttcctcaggtacgacattcgatcagatgatgacctcctacgatgtgagggattgggtggagaaggccttcgacgtatacaagaacgaactggaaggggacaggaacaacaccggcaatccggaacgcgccagaggacggctgttcataaagttcatagcgctgatgatgaggatacgcatccagaatgttttgagggaccacgaccgggatgtgctgcggaccaaggcgaagaaggattctgtcaacgggatgtcggtgagcgaactcctcctgtcgctgaatacggtgttcgccatcggcaacacgggcgactggaggctcacgcacatatcgaagaacatcagagagatattcagcgtcttcggactggagcagatggaatcgggccagatcgttctgggatgatgtaacctatacaatccgcagatttaggtttcgaaatccatagattatgcaaatcaggtcttgagatcccttgcattttcagccattttatggtacgcatccgtcaaaacatctacacagtgctgaatagaatacttcttgcatagcaatttgtgtgcattctcggcaatttctttagaaaaatcctcattctccagcaatttaatcacacagtctgcaaatttctgaggttcatttgcaagaaggatattttccccatcgatcgcttcgttaccctctgcacccagttctgtggaaaccactggaattttagaagcccatgcagtaagaatcttcactctagctcctgcaccaatccataatgggactataaacacttttgacttgtgaaaaaatttcacatcatctttttgttgaccccaaaattttatacttggatggccggatgcgacctcatataatttaccatcgggagtgccagacccaacaatgtgcaatatggttctgggatattttttcaaaattataggaaaaacatactctataaaccataacatcccttgagcatttggaaaccaactaagtgtacccatatataacaaatcatagggacggtcacgcaagtcgtcatcgggagtatatttatttggatctattcctcctcctgtggggattagatatgtttcatttaacccatgatcattgagtaatttctcttcaatgggagatacagtgaatgcagcatcaaaccacgtccacacctcattttcccatttgtataatgactcatatttgtccctgatatcctcaacactttctatagaggcatatggaacccatctttcataaatcatatattcaatattgtgggagtctagaacaatatatgaactcggactggccaattttaaaaaaggaacaatccaagacatttgagagtgctctatttgaatgatatcgtatttgttagatttgacaagttggagtgcacgatccttcaattcctggcttatggtcttccaaacatcagaagagaatccctcgggcataccgccacaatcggaaagatagtgatttgtaactaccccttctgcaaaatttataacatcaatcgactccagataacccttgcactttctagcgtactcttcattatatgttgagaaaattaaatccacagaaattttcgaattgtcatccattttcataaacggtgcaagaactctcagagtcccacccgaaatcgggggacagtccatataatatgtaatatccaatatgcgcacaacatcattttgcaatttttgtccacccccccttttactcccttgttttcacacagaaccaattgataacatagtgatatatcgtgcgtaatgtagatgccaatccatctctcttaagagattcctttacctttgatgccgattcaagcataaatctatattttccttcattttttacactagggctcttgtcatctacatcggaacaaatacctttatcaatctcattcaatacaaaatacttggagtctattaaatcgctcatagcatttgcacgctgaatccacatgttattatcatctgatgtcatgtacaagccctttgaatcctctgactgtgttgcctgataaacattttctatatttatgcatccttttgtcaaaaggactttttcattcaatatcgaaatctcctcggacatcctttcaattcttttatcgatatcagcaatcacgtccaagataactcatgaaaattggtcgtcaatagctcaatctcgtcccctttaaacacatagtgcgccgcggattagtgcctcatctcccttactaccaaaagaatctggtgcaactatcgtcaatgtcatatctcatacacccagaacaatagtttaaggttcacacttattgaattgaacatatttgaaagaccactctctaaataaaacatacttcatagattcaaaaagaaaaactgcgagaatgctgtcgcggagaagaagaatccagacgttgtgatttccgagataacttgtcgagagaagaaccattgccactgacaagacgcaaactacaattgttccgcaacgattgcgatatcctgcaaaaaggacaatcaaaggataaatccatagaataaactgtgtcgagaataccttactaaacagtaaaaagacgatcatggtggccaatgtgcctgctacaatcatcttgagttgctcctcgcccgtttcccccaccccttttttcgatacggcataggcgattatcattagaactagaattacagcaatgatcattacatatgtccatatatcgaccagcgcatcacacaacggcgccgacacatcatatgtatagttggattcaaccatcgagaacggtggccctccaaatttggcaataagcatcgccaccgctgcaactgtgctctcctggtggaagccccgattagaatttgattctatgaattgagttattgcaccaatatcaaatcctgcgatgaccaagactgtaacggcaaacaacacaataattgcacataaagctgtagaagcaagaaccccttttctacactccttgcatctaattgatattattaagaaaactgggattaaaagagcgggggcaattttaatcattgctcctgcaaaagccgcagtagtggcccagaaatattttctcttcaggaataaaaagattgacaaaacaacgaataaccccacggatgcatcaaatttccttatcgccgcctcataatataagctcaccatgagcagaaacaataccgaaaccactgttctgttgatattgcgcatactgcatattttcacaagacaatatagggtcatgaaaaacatgaccgtatttacagctgcgaatatggccgcatacgtgtttatatcggaagtaaacagtcttggaaacataaagaatatcaaagacaagggagggtaccctgtagagaaatccctgtatggaatctctccgcccagaaatttctcagaaatctcatagaacactatgacgtcactcgtggcacaatctaaaccatatatgcaataaagcagtgccagtatcaacatacctagcattagcacattgcgctcggaaaaatcacccatgtccaaaaaagacttcattcctgttcctttaaaacaacccacttattagatatcaatgtacgtgataataccaacagttcttttgacaaaaagaaaattgaacagatgaccgatgcagattaaaatataatagctcacactattccgaatagacagggaacaacatgagcaccaatatcggtcagatcatctacgatctattcggagacaacggagacctaggtgtgctcctgtgcatcttcctgatcttcttattggacgcccttctcgtaccgaccctccccgagttattctttatactcggattcatggccggagcagagcataatactccgatagtttttggttgcgaactcctactggtggcaatcctggcagaattggtagggatactatccctgtactatgtggtaaaacacataagaattcccaagaagatcgagaaactcgttgatacttacactaaattcttggtaatgggggatgaaagacttcttctcctgaatagaatagccccgatgataccgttcgccggtgcattcatagccattgccaaatgggatctcaagaaatcgatgttctacatcgtactcgggtgtgtcctgaagtatgggatcatcatgcttctcagcaacatgttccttgacttcttcaacagcgaccaggcacaactgttcatgataatcatgatcgtcgtggtaatagcagtcagcatgataatgtcgtttgtaataaagaaacgccacggattagatgaaaaacaaccgcctgaaaatgaagattaatcgctccgtataaatagccctacccattagtccatatactggaaggcgaacagatggcaggaaccctcaccgtggtcatccccacatacaacgagaaaggcaacgtcgtcaacatggcaaaggccatcagagaggcttaccctgaattcaaaatcgtcttcatggacgatggttccaccgacggcacgatagacctcgtcagggaacttaacgatccgctgacgaccatctatgtcagagaataggaaaggggacttgcggcctccgtcatggagggttttgccatagcggatacggattatgctctctgtatggactgcgatttccagcaccccatatcagccctagaaggaatatacaaaaaaatggaagatggagcagatctgtgtgtaggggtcaggacgagcaggatgtccatggggttcaagagggctttcggctccgaagctgtcgaactgttctgcaaagtattcttcaaactccatggaaaacagaccaccaaggatttcatgagcggtctcttcgccgtaaggtgcgatgtattcagacccgtcatagaaggttgctgggacaccttcgaatacaaaggatggaaggtcctcatggatctgatgaaatactcggacagaaaggtgaagatagcatactccgaatacgatttcggaacacgtgcggaaggagaatcccacatcaaccccaaagtcccgatcatgacgttccatcaactatggggattcggcagatcgcttgccaaattcctctgtaagatataccacatcgattactacgaaatgtatcctaaagagagaaaataaacccgaaattcattttaaaacagggcctttcggcccttgagaagtttcactcgacgtaatcgagccagtcgtcgtacttgtggtccttgccggtggcgatgtcggagaatttctgatggatcttcgcggagatctctccgggcttcccgtctccgaccgtacggccgtcgatctcggtgacgggggcgacttccgcggcggtaccggtaagccagacctcatcggcggtcgtcagctggaacctggtgacgggacactcgcagacctcgtatccgaggtccttggcgatctggatgatggatgccctggtgacaccctggaggatgccctctgcgacggaaggggtgaagacctttccgaatttgtacatgaagatgttctctccggtgcactcggcgacgtgtccctccttgttcagcataacggcctcgttggcaccctgacggatggcctccctcttggcaagacaggatgcgacataggaaccgttgaccttagccccggcgggaccgcataggtagtcgggcctctgccaggacgaggtgacgagcttgatgcctgcagtggcgttcttaccgagatacgcacccatgttgatgcaggtgatggcgaaggatgcggggacgccgacagggttgagaccgacctcttcaccgctgaggaagatgcagggcttgacgtagtcgacgttcttgttggcacggacggcctcctttatggcgtccatgaccatctggtatgtgtattccttaccatcgaagacgaggtcgatacccatcatcttgcagccgtcgacaagcctcttggcatggtccttgagcctgaagatcgcgggccccttgggagtgttgtagacccttatcccctcgaagaccccagtcccatagttcaaggcatgtgccaggacgtggaccttcgcatcgttccaatcgacaagctttccgttaaaccaaatcttctcgcacttttccatgtggatccttccggtattggcacacctttcagagggcattgagcgccttgacgtatttctcgggctccgaacgggctatgatctcctcgacctgatcagaccctccgaccactccgacgttgccgttagaagtcgaaatgagcgcataggcggactgtccggactcggggaccagttccgcaccgtagacatcctgcagtttctgcagcctgcccatggcaagctccgcctctcctttatcgatgaccgagaggaccattctggacttgcctgggacttcgcatttaccaacgacgatggtctcgacgttgatcttgttgcgggtgaattcgcccatgaccctttgcatgacgccgaactcgttcttgacgatcaaggatatgacatacatgtgtgtcactctgtcgtccgctatggtctcgtcttacttatatttagagtaaaaaacgcgacaatcgtctactgcacatcagaccttggactcgaacaggtcggcctccaccatcgaacacagggcgtgatacaccggaagatggagctcctggaccttgaacgtctccgtctcggggacacatatgcagatgtcgcatagatccttacatctgcctccggtcttgccggtgagacatatggtcctcacaccgcgggccttggcggccataagtgccttcactatgttcttggaattcccggaagtggagatccctacgaagacatcctccttccttccgaacgtctgaacgagctgtgcgaatgcagactccggactgacgtcgttcatgaatgcggtgttggcggcggcgaactgcgtcagcggtatcgccatgagtccgccttccaggttctccgccaactccttcccctcgtccccgtacaggtccacgaggttctcttcgaaccctctgtcgagagcacggctgaatctgaaggatttggtcatctcgccggtgaaatggtcgctgtcggcggcacttcctccgttaccggccagaagcaacttcccatccttccggtagcattctgatatgagcctgtatgcctcgtcgatctcctttccgcagaaggtcagacagggatatctctgaaaaagctcctctctgatctgctccgaactctggactttagctttcatggaaccccactttccgggaaataccgaatctcatcacagacatgacggttgggatataataactgtatgcgggtcaattcccattacggaaatcacgtaagatctcgtcgaccgcatcggcgaaagtgaatgtgccagatacctgatagctcttgatgccgaggctttccccgaactgcacgtccttgtccttgtccccgaccatgtagcatctggacacgtccaatccgtacttccgtatggcctgcagacccataccgaccttcggcttacggcaatcgcacgcctcgtcaggacggtgcggacagaagaatacgtcgtctatccttcctcctccgactgcgatctgccgctccatctcggcattgacggccatcatgtcgtccacggtgtacattccgcgccctatgccggattggttcgtcacgaccaggacgagaaatcctgcatcgttgagtctcctgactgcttccgggacatatggaaacacgtgcatcttggcagggtccccgttatgggggacgtcgggacataatgtatcgtccctgtccaccaatacggcggcccgcccctcagtcatgcctgcttctccaagagatgacgccttcgggttcgaactgtatgtctgtgacctgggctcccgcatcctgaaggatcttggaaagctggggtttcttatcatacttagtgataaaatacatgaaacctccaccgccggcacccgatacttttcctcctatggctccgtttctcatcgccagatcatagagattatcgatttcggaattagataccttatccgagaattttttcttaaactcccaggattctccaagaagacggccggcctcatcgatatccccgtgcctcagagcagtacgcatcctgatggcaatctccttggccttatcgagggcctcgtcgttcttcccttccttgtacgatttaatctgcgtaccgataatggatgcggaatcatgggtcatcccggtgaaacatactacagaacggcattgtaattcgtttattatatcctgggagattctggccggcagaatggcgagcccgttcttatcgatctttatagaattgaaaccgccgaacacggccgcatattgatcctgcttccctcccttgagaccgatgacctccctttcgagatgatatgcaagaccggccatctccattttagacatgtccacatccaaccagttgaccatcgcaccgatcatggagacgatcatagtggacgacccgccgagtccggaaccggcgggaacgtcggaacggatactgaggtcgaacccgtccttcacctcgaaataattggccacggccttgatgagatccatgtttccgtccaagggaagaggtccgtcgtccagcggcgccctgtacctcccatagtacatggacgtgacattcatgttgtggtccttcctcggagtaagggtgctatacgcatatttattaatcgtagtattgaacacgtatccgcctttttccgatgcatacgggtctacatcggttccacctccggctaaccctatacggagaggagcccttgaccttattatctcgaccattttcatcccaccaatctgtcaatgctctgattcacatccactactgtaccgtccctcagaacggaattagttaccttgcaaccttccttaagtatacaaccttctcccaaaatggagttttccacatatgcgtttgtgatattacaaccattcatcatgaatgaacctgatatttctgaggaaaacacatcgcatcctttggatataacggattcggacactttggaggaccttacgacggtgccgtccccgagatacaccgtaccgtccaataccgagtcctcggccgaatccgaccaatcgtgccccctgtaaagacggtccgccatgaccagattcatcctgatgaggtcgtggggacggcctatatccacccatatccctttggccatgtggccctgcaacctctcccccttctcgatgagaagagggaacaggtccttcgagaaatcgtagaaggtgtccttcgggatataccccaagactttcttatcgaccacgtatacgccggaattcaccaggttggagcacgcctcctccctcttcggcttatcctggaattccaggatcctgccgtccccgtcgatacggaccactcctgcctgactcgggtcgtcgacctcggataaggaatccgtgacgaccgcccccgattcgaaatgctcccttatctgggcggctatgtccacagaggtcagggtgtccccgttggccgccaggaacacggggtccagcctgtcttccaatctctttatcgcccctccggtccccagaggcgtgtcctcgtccgagtagattatgcggactcccatgtcgctcccgtcccctatggcatgtgccaggacatcggatttgtatccgcaggcgaggaagatctcctctatcccggcatccgccatggactctatgaggtacttcaggaacggtttgtccaacactggcatcgccggcttcggacgcgtgagcgtgagtggcaggagacgggtgcctttgcccccgaccatgatgacggcctgccgtacttcggacgacatatcgccgagcataacatacccctattaaacgggaacggtcagcggtattccaccctgaccacgttcgtacctactggcacatccagcgatgaggccaccggcagacacttggcccggagcaggtaggccaccggcagggggacctccatatcggacagggactcgtaattggccatgcccttggctatcaggacccctgccctgcccatctcctccttcaggtcttccttcatcagaccttccgagaatcctacacagaatccgcctgtggagacgatcctgtccaattccctgtccatcccgatacggagcgcatcgtccagagacacgtcgttgagtataggtgcccctctgaccacgcctacgaccctcttgcccatggccctgatctccctgatgagaagcctgtcgaactggtcctccccacagttatcgaaggcgtagaggaccgtctcacagccttccacgagccttctcagctcctcggtctggtcggatccgaccccttggtccagaagggactggaacatccttccgaactcgtccgggctgtctatggcgatgcccatgccgaaatccattatgttccccacgatggacaccctgaccgcggctgcgaacctgtcctcggacgaatctatgaaactctgtgcatctggcacatacttctcggcgacccggtcggcctccaatttcatatccagataagggtcggagacccccatggccgcataggcggcggaatggacatgggtggcgatctccgcggaacttatgtccggggacatgagcctcgcatactccctgaccccggcctgtacggcggcgaactccgtcccattatcggccaggcgtgcctggaacaggacacgcttcataaggcacgatgcacaatcggcatgggtcttcatacggctctctacaggagacgccttaaaaagcatttcggcaccctcattttttaatataagcagggttatccgtccgactatggcaacagacaagatttgctcctcctgcgggaagagacttatcggccacggcaacaccttcttcaagtgccccaagtgcggggaagtcgagatcggaagatgcgagcagtgccgcgatcagagcgtcccctacaaatgccccaactgcgggttctgcggaccttgaggtgtgagaatgggacagatcgtttcctcttacgacatcctgcccgagagcacggacatcgacctcaacacggtcatcgagaccatccccaaggtacttcccgagggcgtgaaactcctcgagaccaagatccagcccgtagccttcggactcatgaaagtaaacgccggtttcgccatcgacgactccatcgagaccatcggaaccgacctcgagaacgctctgacctccattcccggaattcagaacgtcgagtgcgtttcttcgaccaactactgatcgcaaaccttcatatggggcctgtcttttcgacgggtcccacatccctttacagctctgtgtaaaaatttccacatactttccctatgcggacgatacggcagagcatgcgtaacaacccaattctgaatatactcagagtttcgtcctcatgtatgtcgagccgttgcgcttatagagatacttcagatagaaccttatcccggcgtaatagaccctcgggaaatggtagaaaccccatccttcgaaatgtcctttgaggtatctgtcatagaggtctttaaattccggaccttttgcgaactccaggaaagcctctttccccatgtgcccgcttgaacgcatcttgatgtatgcgttgttgcggaggactttctcccttacttccggatccatcttcatggagtccacaccattgtaggctgcgatctcatccctgcccctgcggtccatgttctccttcgtacgggtgatcgagccacgagtctgcctgtagccatacagggggcggagatacacggatatcctgtcacagcactggataattccatatgtaaaggatatgtcctcggccatggtgtcctcgaagaacagcccgttgtccaacaggacctccctgctgacgaacttgctccacgccgtgacggggatcttcatcggaacccatgaggagaacgcctctccgcaggtcatgttgaggacggggtactccctgccgcgcttctccctgacgacgccgtcgggaccgacgttcatggcgttgaagcataccatgcaggcccggttctccgtctgtacacggacacattcctccaacagttcggggacgggggcatcgtcgacatcgtagaaccatatgaacttcccagtggcgttcctcagaccgacgttgcgggcaccggcgagatgcatgtcatcggtctgttccaccaccctgcagcggggaagcgatggggcggcctccctcgccttctccaaagaaccgtccgtgcttttgacgtctacacagagaagggtctcgaaatccctgaaggtctgtgccttgagaaaaccgacgcaatcgtctatgtatcttgcgccgttgaatatcggcacaatgacggatacagtcggtctatcgtacgacaatcccttcccactccctttttcggtacataaatgagggatgtttatacgtttattcaatattggatgataactccaatatagtataaaagaacaggaggggtccggagacccctccgtcggatgttttacaatcaagccttaggctcgacgtacctcttgatgtaaccgaagtccatcatgtgcttggtgagcttcctggaccttccgatgatctcggcggccctgtcgtgctcctccttgtaagaggtcttgatgcgggcgacaccctgctcgatcgccttcatggcgacggcggccgcctccctcgggaacacctcttcctcggacatgctggggatgatgtactcctcggtcagacccttctcctctgcacacctcgcaagctcggtggcggcggcgatgcacatctcgtcggtgatggtcttggccctcacgtcgaggacaccgcggaagatggcagggaatcccatggagttgttgacctgattggggaagtcggaccttccggtggcgaacaccttgcatccgtgctccttggcctcccaaggccagatttcggggacggggttggcggtggcgaacaccacggggtcgtcggccatcttgtctatgtactcgggcgggatggtcccgggaccgggcttggaggctgcgatgaggaggtccgccccctccatggcctccttgaggcctccggacttgcctgcaccgttggtcttgtcggcgatctccttcttcagcctgtgggctgcgtcgaggtcgtccctggactggttgaggatacccttggagtcgcacatgcagaggtgttcgggcttgaatccggtggcaagcaggagccttgcgatggcgagggatgccgctccggcaccgacgatggtgacgttggcatcctggaagctcttaccgacgagcttcatggcgttaatggcccctgcgacctccacggtcgccgtcccctgctggtcgtcgtgccatacggggatcttgcagtccgccctgagctcgtcgaggatgtcgaagcacttggggttggagatgtcctcgaggttgataccgccgaaggagggggcgagaagccttacggtctcgatgatcttatcgggatccttggtgtcgaggcatatcgggacgcaatccacgcctccgaggtacttgaatagcatggatttaccctccatgaccggcatggcggcctcgggccctatgtctccgagaccgagtacgcgggtaccgtcggatactaccgccacggtgttccacttccaggtgtgctcgtagaccatgtcggggttctgtgcgatgtccttgcagggttccgccactccgggggaataccagatggagaagtcgtcgaaggacctgatgcaggccttggggacggtctcgatcttcccgccgtagtacttgtgcatgatcatggcgtcttttccgggtttcttggcgagctcgaggcgctcctccacggtgagctccttctcgtccttcttcttcccgtcgtcgcagatcttgtcgataccactgtcgaccttgtcgacggtcttgtcaacgatgttcttgaatttctctccgattcccatttcaatcaccattctacgaatttcgtaagaaatactgcgaagtttctaaactccgatagaattccctgttattaatagtgtttgatttcgggtatggcagacacacatccctgcatacacggaagagcgtggaaaacgatgcccccggggacccgtcatttacatggatggggcgtgtcccccttactttcccgtacccgttctcctggaaacatgtccccgtctggcacagtgcgatggccatgtcgtggaaaggaggacagggggctctccgatcgaacgtaagagcggcccctcgccataggcctccggtcggcaggacctttccgtccatagtcgggtagggggtccgtaccggtacgatatccgcacagaggacatccgggacggaagggacaaaacgcaataaccaaggagggatatggggtcggcatgaaaggtagacccaaggtcgccgtcatcgacggatacatagacgacccggcggccttaggcgtgcctccgtacatctcccccatgatccgcgccgtcgccggcgccgccagggatgcgggggcggatgtggaatacgtcaccgtcgacatgatccgcaacgggcatccgctgccggatgcggacgtgtccgtggtcctctccgggaacaccgtccccgggaagtatctccgttccatgcccatgtccctgaaggagctgaaggaactgtcccccaagctcagcggatggaagatgatcggggggtcctccgccttcgctccggaatcccagaaattcgatttccgtatccacagggacctcgccgcctccctctacgacggcatggtcgggaaagaggtgggggaaagactcaggacgttggacgaatggaacagatggatgcttctgggagcggatatcgtaaagaagcatcaggatttcccggaaccgctcatggtagagatcgagtcgtaccgcgggtgccaccgctgggcgtccggaggatgttcgttctgcatagaaccgtccaaaggaagaccgctcatgagggaaccggaggacatcctggccgaggcggccagactgaaggacctcggtgtgaggaacatacgtgtgggcgggcagacctgcatcgtgtcttacggcgccgaggacctggaatccggatgtcccagaccgaatcctcccaaggtcagaaggcttttcgaggggctccgcgggatgggattcgacaacctgtgcgtggacaacgccaacccggccgtgatagccagatatccggaggaggcggaggaggtcatcgggatactggcggactgctgcacctccggtaacgtactggcactcggactggaatccgccgatccggcggtggaggaggcgaacaacctcaacagcacggcggaatcggtcatggaagccgtccgcctgatcaaccgcgtcggcggagagagaggggagacgggcctcccgaagatccttcccgggctgaatataatatgcggcctcgacggggagacctccgagacgtacaagatggatctggcactgttggagaggatccgcgacgagggactcctcgtgaggaggataaacatccgccaggtcatcggctcacgcagaccgttcgacgtgaaggtcagcgagaaacgcttcaggaagttcaaggagacggtccgcgaggagatcgaccacccgatgctggagagactggtccccatagggacggtcctcaggggcgtatacgcggagatacacgacgggaacataacgttcggaagacagcccggatcgtacccgctgctggtggggatcccctacaaggtcgacctggacaggagttacgacgtatacgtcacggaatggggattccgttccgtgaccggcgtcacctatccgttcgagatcaaccgcatgcccatgtcctccctcgcatccctgccggggatagggaagaagagggccgcggccatagcggccgcgagacccttcggaagcctggaggacctcggaaaggtcgtggaggatccgagggtggtcgaaggcctccgcggaatagtcacattcaattaatccgtaggagataggtacatcagatggacaccctcagagccgcaagataccctttcctgaaggacgcctcccaattcatagaggcgaacgatatcgacatagcggagctgatgacctcccccgactggtccgatgccaggcggagagggatggagcgcataataggctccctgaagaaccacgagatccccgacgtcccccttgcgggtgcggaatacagacgcctggaggagtgcctttcctatccttatgccaggatgatcgtctcctgtatcgacgacaggatgctcaccaaaagatacgccctggccgaggcggagagactcaaccgcctcctgcacgacgacagggacgccatccccatggtcgccgaggagctggaggtgaacgcccacaccaaccgcgacggtaccgtcagcatgcatttcgccgactatctgaggtactcctacgtcatgagtgcgatagaatggaagctcataaacacggatatcagggacggatacgtcctcctgcaggcggacaagttcgacaggcttctccagaacgcctaccgcctgaggatcgagagggaactcccgcttgcggtaccggacgagctgaaaaagtatctgtccaagaacatagagcatgtgaaggcggccctcatggaactcaaggcggccctcagccccaccaacggcgaaggggtcaaggacgaattcctcccgccttgcataaaagcgatcatctccatggccagatccggacagaaccttccccacagcgcaaggttcgccctggtgtcgttcctccacaccatggggatgacctacgatcagatcatatccattttctcggaatccccggatttcgacgagggcaaatcccgctatcagatccagcacataaccggggacctcaacgggaccgaaggctacacccctcccggatgcggagccatgaagaccgacggcatatgcttcaacccggacaatctgtgcgagaaggtgaagcatccgctcagctattatagaataaaatcaggaaagggtttcggaccgaaggaaaggacttgatcattccttcttctcggactccatctcccccagattgtgccaggttatgaacaccctctgtatcgcggtaaggtttccgaccaccgcgaagtagatcatcatgatctcgatcagggagatgtcgtatccgaatatctcgaaggtgtcgccgtagagcatgcacatgacgaactggaggatcgggaacaggaagcagaggaccaccctgtcggcacgtcccagcagaccgtcgtacagcctcttggcgcctatggcctgggcctgtgtacccatgtaggacgtcagcaggacccccatcaccgcgaaaagcccgatatatgtgttgcaccagccgctgacggctatcgcggcgatcatgaacatgtccgcataccggtcgaagacatggtcgaggtagtcccctttgacggagcactttccggccagtttggctatcttcccgtcgagcgcatcgaagtatccggacagaaggaccagggcggccgccaggatgagcatccagtgggtgtcccagctgaggtagaggacgatgccgctgatcgccgccactatgagccccaaccacgatatcgtgttcggattcacgtttatcagacgctttgcgacgggggccagtgtgaagtcggcctcctttctgtgcttgtctagaaccattcttccatctctccagaccagtcgatgtttccgggcctgtatatgtcggccttccctttaataatgcgctctattatgtcggcgacttccgatgcggtaccccgtgaacagtctatctcgttgacggggatgtcggagtccgtcgcctcgcagagtatgacgtccaggacctcggcctgcacgttctcgcggaccttctctggcgagtatcctctggcctccagcctcttggcgaggatgtgcggatcgcacctcaggaccagtatgcgggagcagtcgcactcatgtgccagatgggaatccaagaagacgaatccctcttcctccctatattcttccaaggagtcgttgagggcctccatgtcgacgttgtaggtatccctcccctcatccctctcacccagaagaccgtgcttccgcaggtggtcgttcatatccaccaccttatatcccctggacctgagctccgcggaaacggatgtcttgcccacgcccggggtaccggttatcgcgatcactggcacattatcacttcagataatccttggcacgttcctcgacctgctcccaggtaggggtgttggtaagcgcccccaccttctctatggtgaatgacgccaccgatgccgccaggacgagggactcctcgaccgagtagccgtggtagagtcctgcatagaagcctgcgcgatacgtatccccgcaccctgtggcatccaccggctcccctcccttgaccacggggatcctgacgatcctgccgccgatgcgggcggcactgccctcggatccgtcggtacggacgaccagctccttctccagatcggtgacgtcttcgagacccagcctctcggctatgaccttggcttcgaaggaattgcagaacaggcggtcggacatggagaccaacttctccaatctggcactgtcccagagacggtatgtctcctgggcggggtcggcggctatgacggggcccttccccctgagtccctccatgaggtggagataataatcgggctctccggtacagaaatgaaccatcttggacctagatgcgttcttcagaaggtctttaccgatccgggtggcgaagccctgggggccctggtagaatatgaccttctgacgcaggtccggatcgtttatgacggtacactgggacgtctcgaaatcatccacggtgaccacttcgtcggtgatgaggccggattcctccatctcctccagataggtggcggggaagtcccggccgatgaacccgcacagagcggtggggacccccaatctggccgcttctattgcgatattggtcccggtgccgccgagggtcgtcttcttcgacattatgtcgaccgtctcgtttatatcgggaaacttcccgaccgagacaatctggtctatggttatgtgcccgtatacgctcaggaacggttcggtcattctgcatcgcctccggacgcatgggcgtccgcttcggtatattccccggagaggaccttggaatatacatcctctatggtgggaagatgattgttccagtcgtagtacgacgccctctcggcggccttggcggcgagttcctcgcacctccggacgtcgtcgaaaagagcgttcatcgcatccgcgagggccttgggatccctcttcgggaccacgacaccggcatctccgaccgtgtccggaagcccgtccgcatccgagcagacgatgggcctcccgcgggacatgagctcctcggctgcaagacccagactctcgaataccgacggcattacgaagaacctgcagtcccccatgagcgcgtgcttctcctcatcggtgacgtatcccttcatctcgatgcggtcctccagaccgtatttcgagatgagtctcttcagacggcggtcctccggacccttgccgcatatgacgagcctgtggtccacgtccctcatggcctccacaagatattccagacccttggtcttcacatgccttcccagggacaggatgtagtcgcccttcccctcgccgggctccaccggcgtctggagacatgtggggaccgccgtgacgtatctagcggaataccccctccgtagaaggtccttcctgacgtagtcgctgacggctatcacatggtcgaatgtctcgagcgtcggtgcgaaacggtcgtcgttcatctcggagaaccttcccatcagtccgaccccttcgccccacatgttgtgatacgtgaacaccttcttcccgtcgtacttcctgagatccttggtgtagctgggtgcccagcggtagttgaaattgacaaggtcggcatccagggattccaaggcctccaggacgcccttggatgagatgaacggagggttgtagaccctgatctgcctggatttcagacggactatgcggtagccgtccatcgtctcctcctcgggggagtcttccgacagcctccccgtaagcaccgtgacgtcgtggcctttggcggccaggagcctcgaggtgtcggccatcctgcgctctatgcctcccctgtacgggtagaagaacggattcacatcgacgatcttcgttccttatccctcctcttcctgttctcttcgattacctctccgtagacctgtaccaacctctcggtggtcggtccgaggccgtaggacagcgccgtctccatacccctgtccctcaccgcctgcggggaatccaacgcctccattatggctctggcacattcctcttccgtgaggccgaacaggtatccgttctccccgtcgcggatgaagtccgtgaatgcgcgtccgttgccgcaggccaccggaaggccgcaggacatggcctcctggaccgtgaatccctgggtctcgaagacggaggcggagacgaatgcgtccgcacacgaataatggtccacgaggtcgtcccccttctgatatccggtgaacacgaccctgtcctgtagacgttcctcctctacgagcctcctcagcccgtcgagggccgggccctgacccaccaccatgaggacgatgtcgtcttccaggagcttcagggaccttatcacgagatccacgttcttctcgaacgagaccctgccgaccgttattactatcctcctgccctcgagaccgtatctcctgcggaccgcttcgcccgcctccggcctcctggtgaaacgggcgttgtctatgcccgtaggtacgacctccatcctcttcggtttcacaccgatggtctcggtcacctccctgccggcgctcggggtggggactaggatggctgcgggcctcttcatcatctgcctcagatagacggatgccagtctgaccagcgtttccttgggcagcttgatgggggaatatctgtctatcacgtctgttaccagggtgtcgtaggtcagtaccactggcaccttggtgttatgcgatgcgataagggccttgatcgccatgaacgcgaccccgcggacgtgtatcacgtccgggtccagcctcctgatgaggtccgactggtcggaggggaaacagggtacgaaatacccggggtatgtcctgaacctgacggcacggaaataatacaccccttcctcgcggtactccggacccgggtcgggagcgatgacgaagaccgtatgtcccagatcctccaatgccttcttggtcaccaggacggccgtcaccaccccgtcgaccgtggggcggtagctgtcggtcattatcgcgatgcgcatctgctcaggttccttcctgccagctgtggatatagtcgtactgctcgggggtcagggaatcgatctcgatacccagcgacctgagtttgatggtggcgatctcgttgtcgatctcgtcggggacgcggtagacctgacagctcatcctctcgtggttgttgaccatgtagactattcccatcgcctgggatgcgaaactcgtgtccatgacctcggcgggatgcccctggccggccgccaggttcatgagcctgccctcggctatgaggtagagtttcctgccgtccttgagggtgtatctgtcgacgaagtccctggccttctccttggagacggtcatggcgtccaggtccttcttgttgatctcgttgtcgaaatgaccgacgttgcccatgacgcagccgtccttcatgttggcgaggaccttctccgtgattatgtccttgcatccggtaacggtcatgacgatgtccgcggtcttcacggcctccgccatgggcttgacctcgaacccgtccatcctggcctcgatggccttgacgggatccacctcggtgacggtgacgatggcacccatccccttggccctcatggccactccctttccgcaccacccgtatcctccgacgacgagatgtttgccggcgaccacgaggttggtggcgttcatccatccgtcgaaggcggactgtccggtaccgtacctgttgtcgaagagatacttcatcttcgcatcgttgatgtccatgaccgggaactcgagcttcccctgggcggccatggccttcaggcggatgacccccgtggtggtctcctcgttccctcccttgatgttcttcagggcgtccctgcgtttggtgtgtgccatggtgatcaggtccgcaccgtcgtcgatgacgtagtcgggggagatgttcaggaccgcgttgaggttgttgtaatattcctcctgggtctcgtatttctttgcatgtacgtcgagaccgtactcgttcctgagcgcggcggcgacggagtcgtccgtcgagagggggttgcagctggcaaggcatatcttcgcccctgcgttggcgagcgtcaccgccagcatcccggtcttggcctcggtatggagggccattccgatcttcagaccggcgaggggctgctcctccctgtagcgtctgtcgagttcctgtatcacgggcatgtgctcgtatgcccatttgagcctgcggctcccttgttctaccagtttgtccattcttctcactccttgaactctgccataagagaatcgcagatgcactcgatggtctgtctcctcgtctccttggacgagtaggaggcgatcacggcatctatctctgcatccttccctttgagctccctcacgaacatggtaatattcgcaagggccctcgttatctcgtcggagatgggcacggacgccgccttcgacgtccttgaaagcgggttgaggtctatcgagatgacggtcttccccatggcgatgagggcctccgccctgtccccgtcctctatcgggaccaggatcacatcggaatcgtagaccccggccttggagcacagggcacggtccgacgtcagacccggtatcctcgcatccggctcccttccgaggacgcccctggccccctgggactccatataggatatcagagcctccatcctctcctccgtacggtggaatatgttgacctccatcctcgcaggtacggcctccgaaagggccatcagacccttggggtccaacgctatggagttgccgttcatgcagacgatggggttcctggctctcaggaggaaggccgccgcggccttctccgcggcaagcgccggggctatcgtcttctcgcccatgagataatcgaaagcttcgcctctgccgtgggagatgaggcccgtgggattgactagcccctcgtccaccatctctgcgaggtgctccctcaccatgagggacttgtaacgcggatggtccttaggtgttgacacgcccactcgattgcatcatggcgtattataatatcgcgcattaggaagggcttacatgtcggactctatcgtaccggacgtgtacgggacctctgccggcaactctcccagttccacgctgttcctcagcctgtcgacgatgccggcgacgatctcgtccctcatcgcacggtatgcggaggggttcccacgcttcagggatacggcggtacggtactcggtgccgtcggcctcgaccctgccgccgcgctgggcgataacagaatccaggtcggaatccccgaaataaccgtccacgtcgagccgtacggcctccatcaaggtatctagctccgtgaactcctctccctgataccaataggccatgttatcggcccatatcatgcaggtccagtacttatgacctttccggatcgggccagcaggaccgggtccgtcctagatccgacagatacacggccctgtaccggagattgatgcgggacggatgtccctccgcctcccccccccttgaggacctctggaacgatccggtggagatccttacagatattcgttatgtctatcgtcacaatggtgtccctgtctgttgtgagcgctttaaaaacgtatgtttaaaataaaggacggcataacgtcccttaagacctgaccgccccatcctctccaaaaacccatataataagagcggatgaaagaaacctattatgcctgatatccgcgtcgtagtcgtcggacccaagttcgaagggaatgtaggtgcaatagccagatgcatggccaacttcggtgtcgaagacctggtattggtcaacccgtgcgagatcggggagaccgccatgaacagatccaagcacggagactacatcctccgcaacgcaaggaccgtgacctcgatggaggaggccgtggaaggatgcctcctcgtagtgggcaccagcggcacagtcaccaagggcgacaagaactatgcccgcatccccgtggacgtaagggagttcgcaatggactgccgcggatacaacgagaagatagcattcgttttcggaagggaggacatcggactccttcagacggaactcaacagatgcgacgtcctcataaccatccctgcggacgacaagtacccggtaatgaacctgtcccactccgtgggcgtcatcctgtacgagatgttccaggccaacaggagaccggtccgctgcgagccctgcgacggacgcgagaaggagctcctcttccagttcttcggagacctcttggaggagatagactacaacgaggcccggagggaatccaccaccgtcatgttcagacgcatgatgggcagggccatccccaccaaatacgaatacaacacgataatgggcgttttcggcgatgccgccaggataatcaggaactatcaggagagcggcacgaaatggggaggaaaatgaaggccccgttgccttcttccagatccccttgaacgaaatccgggcacagccccgtccggtctgcgaccgtcttcaccaccagttcgcgttccaagtccgatgcgggcgcatcaggacatatgacgaccttcttgcccaccggatcggtcgggtatagagggaatgcaagagcctgttcgacggaaccgaggagcgaagactcgctcccgtaggagaacgtgtagcaccggctggacatcagcgagaggaacggcgtcgtctccgccaaaatcgccacctttacggccacatgcttcatgagcagttcggcgccctccaaagcgcgccccatgtttatggtcgtctcaccgagttctttggcgctttcgttatccatgaggaacatacggtccgataccttctgcacatccgggagctccttgagagcctccgaacggcgttcggtctcgaacttccaaggcatgtatacgactgatatgaatgggatatccagcgatctggcacattgggccagggcgattatcgcaccggctcccgtaccccctccgagggccgccacccctatgatggtggaatgcccccttatcttctcgactatctcctcgttatggatgaacatggcatgatagtacgcttcatccctgtcccctttgaatcccacatcggtgttcccgctgtcgggcaccacattgatatcagcatcggagacgtttatcctgagggcgggaaaatcgaagctggcacatatgcgggaaaccactctgcaacccgcacctccgcatcctacgacgagtgcggaatacatatcagaattccttcctatcggacatgctacggtccagagcctctctgaggacatcttccgcaccggacccgtcggccgtgaaatcacttatgtcggcaccctccagtctcgaaacggctgcaagggtcttctccctctgttcgggcgtgaacaactgtgccaggaggtcggatacggcggtacggacgaagtccgattcggtctcgaacttcttgtccgataccaatgaggtgataagtgcaagatcatcggcaggcaacctgacggtcactcttttttccccatccatacgtctgcaccgtaatctgataacgagtgaacagggggtcgagccccctgtagtaaaggtaaggcgtttttcttgattccgagaaagttctcgaacgtcagttcatccgaagagtgcgctgagtccagcggcagcctcgtcctcgctgaccttctcctcctcagcctctgccttttcttcggcgggggcggctgcggcagctgctgcgggtgcggcggctgcggctgcgggagcggcaacagaggcgtttgcgatagcctctttgatgtcaactccctcgagggaggcaacgagtgccttgactttcgcggcgtcaacttctacgcctgctgcggtgaggatagccgtgatggcatcttcagtgatctcttttccagcagagtagaggaccattgcgctgtaaatatactgcatttctttcaactcctttatccgaatagagctccaagtcccgcggcaacttcttcctcggtctgctcttcgctcttttcatctgctttctgctccgcctcggcggcgggctctgctgcggcggacggtgctgcgactgcaacgctgttaagccttgcagcgatgtcatcgttcgtgaatccggacgcagaagcaagggcaagcatctgactgtctgccttcgcaaaaagcgctccaattgtctctttagtcggtatcgcggcctcaacagacagcgcagaagcgctcctgtatgccttcgcaatcagcggtacgatagtctccttcgcagggtatgcgagctcgactgcgagcgccaacgcgtcgtgcgcggccgtagcgaacatagaggtgtaataatcgtcaggtatgtccagaacatccaggccgtagacaatcccatcgccgtagaccgctctcgcgttcattccgacttccatgggaaggatctccagcttgggaagcattgctgcgagttcgggagagatgggctctccgcctttcacaacagtggtgtccttcttgacggttattttcccgttcatgatctgagcgggtaggcctagtttttgaagttcaccgatgatcggtccgggtccgaacggagtaggtccggccggtacgacgatgtcgtacggtgcgatctgtcctgccttagcaggtgcgggggtgctcgtcgccttcagcttgttgaagagcttgaaggggttgaggtccgtggtaacgatcgcgcactgtccgccgacgtgctccttcagcttctccactccgggcttgaactgggctgcctcgtcgagggccaagagcataaggttgttcttggtcatcttgatcttggcgtgagccctcattcctgccctcatggactggatctggggagcggggatctcctgcatgtccacgatcgctacgaccgggtactgctggatatcatcgacgatctctttgacgatgtccttcttccaacttgcgacgtgtgccatccttagacctccctcacataagcctctctgacgggcccatggtcgtcttgatgtacgcggagtcgatgttgtgctttcctttctcaaggtggccttcaacacgcttcatgatgacatcgacgttgtcggcgatgtcgtctgcggacatctccacggttccaacgggcacgtggaaagtcttcctgtctttcgtcctgacggtaacagacttgcggaggttgtcaatcatcggggccggatctgctccgggagcgatgggcttaggcatctttccgcggggaccgagaacggtaccgagcctcttaccgacgaccgccataaggggggcctcggcgatgaagtagtcgacactgttcgcgatcttctttgcctgtttcttgttgccagcgagggtcccgagttcctcgggagtgatcactaggtcagcaacgtccttggctttcaaggctagttcgccaccgccaatgacagcgatcttgacctgctttccgcggcctttcggaaggacgacgtcctcctgaatacggttcttcggaagagacaggtcgatatccctgagattgacggccaactcaaccgtttctacaaatttgcgcttcttcgcactctcaagtgccttctgcacagccattacggttggtttatctgccaatacaattcctcctcgtagtactaacgggcggtgaagcccttctacgagcaaagatgcaatcagattcccatatttaaagacgatggcacaaaaatacacaatccgtccatcttccccatctaacgcagtatatataggcccgttgccgggacggaggatccgacggcatcggaacgccctttctccatatataaagatgtgaaaatattttgaacatgctcaaattttttctatatatatcgccgatgttaaccctaaatatctcctaaaaatcaatgattcccatgtcagaagaacagggattcaaacccggcaggatggcattggcggtattgctgatagcatccatgctcattttgatgggaggagcggccgtggcaccggcacttccggtgatctccgcagcattcccgaacgagagcgagttcgtggtctcgctcataatatcgataccttccctgggggtcgccgtgttcggcttcctcgtcggtatcgctgccgacaggataggaaaagtcaggaccctgatattctccctggccgtcttcaccgtatgcggagtctccgcatatttcctcagcgacatgaacgccatcctcatagggcgcttcctcctgggactggggatggccggcatcggtgtgaccaccaccgcactgataacggaatactacagcggccccgagatggtcaaaatcgtagggctgcagtccgccgccatgggtatcggcaccatgtgcctcgagatagggggcggttccctcgcggaactcggatggagggaacccttcctcatatacctgatagggctggtggcgttcttcgggaccatactggctctgagggaacctcagaagagacagggccccggggccatcgtcgagaggccggtcccgacggattggaagaggacggtcgcagtgtgctacctgtccatattcgtgatgcagatactcatgttcatgtatccggccaagatcggatactacgtcaacgaatatctcgacgtggagaacggcagcatgatgtccggggtgttcctggcgtttacgggatattcaatgcggtcgcctgtgtactgcacctgcgcatcgcggaaagattcgaccgcccgactagactggcactgtgctacctatgcttcatggcaggaggcgttctcatgtggggtgtgcataacatcttcaccataatgatcgccttcacactttccgggattgggctgggattcgggatccccaccgtcgtcaactggctcgccaccataaccaatccgaagacctctgggaagataatggggggatacaccatgatgctgaacctggggatattctccacctcgttcctcctgaaccccatactcgcactcatgggaggacccaacgagtatgccgggatgtacctgttcggtgccctcatgtcgtttatccttatggtggcgatgatggtatacaggcccgtgtatcacaagacccagaagtggtaaaaccggctgcggcccatccttaccatgcttatagggcatggaccttttccaccccatccgacggcatcttgctatgacggctccgcgatggggggatgtgttgactgacaaaacagcccgtggacctccggatcgctgttttattggcatatgataaaaccagtattctatggcgggatgtctgcctatatcgaaagaagttcgcgggaaatgtagtaaagtccggaaataaagtcgcggaaaatgtgcgatatatatgtgtctggatattgacggacggattacattaccgatcggggatcgagggtatgagatatttcagaagaaagatctatgaagacctcctggaatggaagaacaaatgggcaggcaggtatgctctttcgatcgagggagccagacgtgtaggcaaaagcactattgtagaagaaatgacgtggctcctataacgattgcaacgtccggaattatgtataagtgatccgggacacggaaaacaccgcgtcccggctgtatcgtttgacgaactcagtgaccgaggacgtcgtcgtagacgccggccttcaggtctttctggaagtccttggggttcttgccgtcgatagtcacaccgaggctgacgcagtttcctgcgacctcggagacacgggccctctcggtcgcgcccagcagagagtcctgcttcatggcggcgatcttcttagcctgctcgacggtcaggtttccgacgatggtggtcttcgggttgccggatccggtctcgattcccagctcgcctttgatcagtgcggacacaggcggggttccgaccttgatgtcgaaagtcttgtcggggtttatgaggatcttcacaggtaccttcattccctcgaatgccttggtcttctcgttgatcttcgcgatgacctgtccgatgtttactcccttaggaccgagtgcagggcccagaggcggacctgcggtggccttgcccccgtcaaccaatgcctcaacagtatctaccatattcatttctccttttctactactctgacactgtcacccttgacagtgacggggatcgggaccatggcatcgacgagctcaacagtgatctcctctttgtcctggtcgatcttctggaccctggcggtctcgcccttgaacggaccgttgacaagctccacaaggtctccctcttctatacccacgacggcagagacaggcaccagatagtgactgatctcctctatcgaggactctccgtcgatgaaggaacgtgctttcttgatatcgcgggtcttctcgtgcagacggtcggtgttcataccttctacgaacacatatcccctcagaccgatggggctcagtacggcatagatgtcatgctcgccctcgctggccttggccataaggctctgagcgactactttctcctgatcgatctgggtcttcagaacgacgatggactgccttgctacggccgagaactcgtccgtggcggaacctgcatcggaagtgatcgtgaccgagatgttcaccttgtcgtcgtatctggctcccttggggcagatgacctcgagcttgagctgcttggaagtgctgccggggaagtcgacctcgacctcgttcttggagcggaagttctcccagatctcgttccctacggaatcgtagagcgtcacggtccattcgggtgcattgtcagggtcgtcgctgttgacgctgaaagccagtgtggccttcggtgcgccagacgaagcctggaaatcccagtagactatacctccggcatggacctctttgagcccgttgtcaccagtaaagttggggcctctcatatcgtctgacatatcattcaccctcagaagtaatcgggaaggtaggtcatgagccacatgatgaagaaaccgagtgctccaagcagaactatcccaattgcggaaatcttggcggtcctaagatactcctctttgtccggtgtgtgggccatctggaggatccttccgtattttcctctgccgatgcctttaatcttggactcgaggttgtcctggaactccatggacctgtcctctgctccttcgtctgacatttttaccatcctgtatcgagcgccggagtactccggcgtccgcgatttactctttcgttaccactgatgtgtaacgaataagcaaccacccctacccaagacgtttattttaaaggtttcgctgattgtccgtattttaataaagaaaaagaaaagaacggaaagcacatccctccgccctgtcccggactcccacggaaccaatcaacaatcattttatagggggtgcagattgtacccctattaatcctgcatgaggtattatcatggaagaggttttgtgcaacgttgaacttgtaaaagacaacaacaactttatcgcaagaatccagagcgacttcggcgggatgagggaatacaagtccaccaacttcgaagaggtccttgagcagatgaccatggaccttcaggaagagttcgattcggcttgaaagaccgcgggtgattaaaatggctgacaagatcaaacagattgctgatgcgatggacatgcttgctgaggacacctccgttcccaggaacataaggaaaggagcgaccgatgcaaaagccaggcttctcgacaccaaagatgctatggacgtccgctgcgcaggagcgatcaatatcctcgatgatcttgccaacgaccccaacatcccccttcaggcgagaaccctgatctggcagatcatcagccagctcgagaccgtcgccaaaggaaactgattctcaaacacccccgtggaaacacggggattccttgacttctataacgtctgcgaccatgggacgacgtatgccatccgacatcgccgtttccatagataaggacggatgcatcggatgcaatcatctgatagacatccgtcgataccgtacaggttgtccgtaccttacagaatacagggcccatcactgctgacggacccggccgggacctgcgtatccgcaggtctgggtcattgtctctgtcccttgattatctcgaggaagttctggaatatctcggcaccgtgttctgtgttctcgacctcgggatggaactgcaccccatatagtggacggtcgatgcatgcgatcccctccaccttgcaggaaggagacgacgcggtcaacctgaatccttcgggaacggccttgacctcgtcgttgtgagacccccacacgatgaaatcatcgggcagacccgcgaagaggtccgagtggtcggacaccttgagcctgacctccccgaactccggcacatcggcaggaccgagcgcagagccgaaatgctggctcatgaactgcataccggcacatatacccagcacgggaaatgtcgccttatccaggtactcgtcgttgttgcccatcctgttggagtcgcacgccacactgggggctccgccggagaggacgaggccgtcgaggtccttcagttcgtcgaacggggtggtgttcggtacgatcttggtctcgaccttgagatatttcagtacgcgccactcacggtgggtccactgtccgccgttgtcaacgacatataccttcatggacggtaatctccagtagccctttataaggataatgccagccggcatcgtccgcacccctgcggaaggacagtaacatttttcgtacatggagtcgtttttcactcaaggggctatggatatggtgaaacagaccgccgggaaagacaaactgggcgacttcgctccgaagttcgcggacctcaacgacaacgtactcttcggagagatatggtccagggatgacaagctttccctgcgcgaccgctcgatcgtgaccgtcacggccctcatggccaaaggcatactcgacgactccctgaagttccacatagccaacgccaagaagaacggggtcaccgccgacgagatggcggaaatcctgacacatgccgcattctatgccggatggcccaacgcatggtccgccctgaccatggccaaggagatatacacggcggatgaaaagcccgccaaagactactcttacacaaaggaggacctccagtacttcctcgacaacatgaagccgggaacggtgatcagactgaagacccgcatgtgcaaggtcatgaacagggtcagcaaagagacggcgaagctctgcatggaactgaacgacggatacaagacttccgatgagaggagggccatgttctcgaagatcatcggaaaaccggtcgacgggaacttcagggtcttcccgccgttctattcggatttcggaaagaacatccacgtggggaagaacgacttcatcaacacctgctgccacttccaggaccagggaggcatatatctgggggaccacgtcctcataggacacagcgtcacattggccaccataaaccatgttcaggacccggagaagagaggcgacaccatctgcaagcctatacggatcggaaacgacgtatggatcggggccaacgtcacggtggtgggaggggtcaccatcggagaaggggcgatagtggccgccggagcggtggtcacaaaggacgtccctccgaggaccgtcgtcgcaggagtacctgcgaaggtcatcaaggagatccaatgagccagatcctccgatgtggatggggcggggacgatatacgaaggaaggtccgacgacttcccgacattccatcccacatttattccagtaccctggacggcctcatcggagatccgaggtgtgtaagacggcgtacggcgatacgcctgaaaaatggaaggggcggccctcgggccgacccctttgatggttttactcactcccactcgatggtcgccggaggcttgctggtgatgtcgtacaccacgcggttcacctggctcttcatcgtgtcggtgatcctgacggagatcctgttgaggacctccagcgggagcttggagaatgtggccgtcatcccgtcgatggaatcgacggcacggatggccacggtgtatccgtatgccctcctgtccccctgcactcccacggatttgctgggaaggaggactgcgaagtactgccacgggcggacggcctcaccgttgccgacggccttcatgatctcgtcctcgacgatgaaacaggcctcacgtacgatctcgaccttctcgggagtgacctctccgagacaccttatggcaagggcgggtccggggaacggctgcctctcggaagcttctacgccaagtttccttgccacctgcctgacctcgtccttgtaaaggtccctgaggggctccacgagggtcatgttcatatccttggggagtccgccgacgttgtgatgggacttgatggtgtcgcggacgccgtccccgctctcgatccagtcgggggcgatggtcccctggaggagataggttgcaccgaactcgcgggcatgcctctcgaacactctgatgaacttctctccgatgaccttcctcttcccctcggggtcctccacgcccttgagggcgtcgaaatactcgtccgcggcatgggcgaccttgtagttgatgcccatgttcttcatcatggcctcgacctcgtcggtctcgcctttcctcatcaggccgctgtccacatagatcgccagaaggcggtcccctatggccttgctggccagcgtagcggtcaccatggagtccactcctccggagcaggcgatgatcgccttaccgggggcggggatgctctcctggatcattgcgatcgcttcgtctatgaacccctgctcgtcgaaaaatcccgtcatcattccaccttccttgcttcctcgaccacgaaggccgaatccttctccaccttggccgccatggccttcctgtcctcgcacagcttctcggcgagacctttgtccgacagtgccagcatctctaccgcaagcgtggcggcattgtctccgcgatccattccgaccgccgccacggggatccccgggggcatctgcacgatagataggagcgcatcgtagttcagggatccgctggcaggaacaccgataacgggcttggtcgtgaatgaggcgatcaccccgggaagggcggccgagagtcctgctatcgatatgaagacgtcggcatcgctgccggataccaggtcctcgacccttttaggggtcctgtgggcggatgccacagctatgtcgtaggccacaccgtatttgttgaggacggagatagccttctgcgctatcgggaagtcgctcttgcttcccatgattatgaatacctttgccattgcgggaatgacggcagaatacgatataaacactcgtacgcgcacacgcgtggattatagaaaaagcaggtgaaaagaaaggtaagagtgatcggaggccccggcagaaagccgggcctccttgaaaggatttttggatcagctcttcagaacggtcacaaggaagattccgacagcgaccagggcaccgaccaggattccgatcaggttgatgattgcgtcgtagaagacatcccatgcggcgacgtcgcagaaaggctcgatgttgctccacgcgatgaggtacagccagagcagaccgacgatgagtccgactgcggcgaggagaattccgtatcccttgttctttccttttccgaagtatgcggagaaaaccccagcagcgagcgccaccgcagcgaatgcgatgatgacgacggtgaggaactcccagatggtccaatccattttttagcctccgattttagacgggcggcccgcaggcgcccaaacttttacaacaatgcacatcattaattaaaaggttactggcatcttttttcctccgacagatgggcgatcgcaccctccgataactatggccagacatgccgaatgacaaatcaaaaacatcataatcgacgattgacgaagatacccgactcgtagggacatacagtaaggcttaaatgtaataaaaccgggaccgaggggatatttcggataaacaaaattgataggaattaaatatacaaatccacaatatagataaagagatgcgattattttaaatagaaccgctgctttccttatttataacgttgggggagcggctatggattttttgggaactgttgacggcatcacttctgaaggacgtatagtcgtcagatgcgaacaggccccggatatcggtgacgctgtattcgaccagagccagaaacgcataggtacggtgaaaagggtcttcggaccggtagacggaccgtatgcgtcggtaagcccgaccgagggcgtaccgaagaagatcgagggaaagaagctctactgtaacaagagggtcaaagatggtaaaacaaagagaagaaactgaagagatcaaggtctgccccgagtgcggcagccaccacctggtccgcgactacgagaggggtgaactcgtctgcgaggactgcggtctcgtcttggatgaccagttcatcgaccagggacctgagtggagggccttcgatgtcgaacagggagagaagagggcccgtaccggtgccccgatgacctacaccatccacgacaaaggactttccaccgagatctcctggaagaacaaggacagttacggaaagagcatccccaccagaaaccgcgcccagctgtacaggctgaggaaatggcagaggaggatcagggtctccaacgccaccgagaggaacctcgcgttcgccctgtccgaactggacaggatggcatccgccatgggactccccaggaacgtcagggagaccgcggccatgatctacaggaaggccgtcaacaagaacctcatcagaggaagatccatcgagggcgtcgtagccgcatccctctatgccgcatgcagacagtgcggtgtccccagaaccctcgacgaagtcgcaagttccagcagggtcggcaggaaggagatcgggaggacctacaggttcatgacccgcgaactgaagctgaagctcatgcccaccaaaccccaggactacgtccagaggttctgctccgaactgaagctgagcggggaggtccagaccaaagctgccgagatcctcaaggatgcgtccgacaaggagctgacctccggaaggggtccgaccggagtggccgcggcggccatctacatctcatccatcctgtgtaacgagcgcaggacccagagggaggtggcggacgtcgcaggagtgaccgaggtcaccatcaggaacagatacaaggaactcaccgagaaactcggtatcgagatccagctctgaaacacatttacggtcccttcgggggccacctttgtttcatgcatcgccttacaaagtaaggtcctccgacatgccagttttaatatctcttcgaatacgtcgtacggtccgagggataaccatgggacttggagacaaattcaagaacatcgtggacaagaccgtagacaggatcgatgacaacatcacccgtgcgggtgaggacgattccgaacacatcgcaaggtactgcaaggacctcggcatcggagacgccgtcaaagagaaggctctcgccatcctgaaggataccgacggcaaggacatatccagcggaaggaacagggcggccgcctgcatatacatcgccggcaaacagtgcggcgaggccaagaccctttccgacctcgcgaaatgcgcaaggaccaccgaaggcctcatcagggataaggccaaagaggtcaaggacaaactgaagatcgatgtcgagatcgaagagccctcgaccgaagaagagaagaaagagtaaaccatcctctgcccccgaaagggggcgcattctatcacaaatataacagtgccaggatccgaattctctttgcaagggggatccctgtaaaacatcccgaacgccctcccgtcatagaggcgtcggagaagaccgcgttcatctatcgcatcgaagggggcatggacgaccgcgacatggacgagatggaggcgatggactccggatacgtcctgggaagaaactagcccaccatcgtgtccgagtccgtcgatatcggacatcgcatgagatacatgaggaaaaggggtctgggcttccgcttcctgcgcatggaggacagggccttcgaagatacgctgaggtcatatgacccagatatgccggagatacttgcatggatggtctccgaggcctatctgaacggcacctgcagggcatcggacatcctggacaacatcgagtccgtcaaccctctgggatacgaccgcccgcgggccaacggaacctatcgtaagaaggtcgtcggtcttctctccagatactcggaaggggccgaggactatgtcttgaaaaggacccccgtcgggagactgggctgcgccgagatatggaagaccgccgttccgtcttacgagatgcgcctgatactccacgtatccgcactccgacggacggtcatggcttgaaccacttgaactcgagatactcgatctcgttgcttacgcgtgcgaagaggatctccttcttcacaccgccggacagccttacggtcctggagatctcgggccacatggccaccgtcgacacggggacggcatgtaccagatacctggcatgacagtcgtcgggagacttctcgtagactctgaaatgggtgccgtacttgaaaccggtcttcaccacaagacccctgttcctgagatccacatacgtcctgagacggaggtcgaactcatcctgggtctttctgccgaaagagaccaggtccttgtccgacatcccctttcccttacggttgaggacttccagttcgcctttcccgatcagataacatccctcgatcagggagagctgcaggaccccctgcatatccttgccgtagaacgcctcgtcatgaagggcctgtccctggtccttgtcgaaaacgaatatcctgtccccgaccagctttccgacggcctttgcagtcccctccgcagggaggaccttcccctccgggtccatcatggccattttgtagtatgtgaggtccccttcctcgtcgacgaccccgtacaggagctgtttgcccctgtcctcggattgggacacctcgttcaggaactcccctatgtccagagcggcacgctccgagaccgcgcataccatgtagagaggggcggaattgctgggggacatccccctaggatacacgcggagatcgaaactccccgattcgggcttgacaatgaaccctctttccctcaggtccttgaacacgatgtatttgatgtcgaaattgtcgacctttccggaagcatagtcgaagagttctgcgaaacccatgcgtttcttcttgtggaagacctcgagacggtttgcctgcacgaggaaagccgcctccacgagatcgagttccaggaagcctccgctcataggatagccgaagttgcctttggaataggtttggctggcttccctgacgtcacggatgtagacggagcaatcctcgagttctcccggcatatggagcgagttacggtcgcggattatattattattggcacggagaaccgcacgtataaggactgtatcctcggatgtgccagacaactatttcatcccggaagcccatggaaaggacatgtgtaaggacgatacccggccgccatacagaaccgtgtctttctccggatacctgtcggagatcggcatccatccgtgggtatcggacatcgcggccaacagcataaggtacggcaccccgatagacaggtcggtcgcggacaggatgtcaaaggcgttccggggattcgtaggagggaggatatgcgccgggaccgtctcggaagccgtgtcccgtcagggatatacggtatccgatgtcggcagggactgcttctccgtgatgatgaacggggacgtctggcacatatgtctggacatccttccggacaaaggatctgccggccgcacggtcgtcctccgggacggggtcccgtccatggacggcgaggtctcatacctgccgtactatgcggcaggcatgttcacctgcctcgatcccgtacgcagggacgaattccggcaaagaagggtggagtatcattggcccgatacatccatatcgggccgccgaagaatatacaggtgtttgtaaaggcgggcagagcccgcctgtttcatgaccggatcagtcggacccggacttgggaagggtgccttcgagggcctgttcgtaaccgtagagatccagaagcccgtggccggaaaggttgaagacgatggtcttggcctcgttcttctccttgcattcgatggccttgtcgatggcgcacttcagggcgtggcaggattccggtgcgggaatgatgccctcggtccttgcgaaggtgatacctgccgcgaaggtgtcggtctgatcgtaagacacggcggagatcttgtgctggtcgaaggcggcggataccagcggggacatgccgtggtacctgagtcctcctgcatggatcgcgggaggtatgtactggcttccgagcgagtacatcatcatgagaggggtcatacctgcggtgtccccatagtcgtacttgaactcgcccttggtcagggagggtgcggccttcggctcgacggcgatgatctcacagtccttgtgcttgcctgccatcttctccctgaggaaggggaaggtgaatccggcgaagttgctccctccgccgacgcatgcgatcatgtaatcgggttcgatctccccgataccgaactgctggagggtctcctctccgatgacggtctgatggagcatgacatggttcatgacgctgccgagggcatagcaggtgtgctcgtccttggcagccatctcgcatgcctcggagatggcgataccgagggaaccggatgtctcgggatgctctttgaggaccttccttccgaagtcggtatactcggacggggaggcgtagacggtggcaccgtaggtgttgatgatggtcttcctgagcggcttggccatgaaacttcccttgaccatgaagacggtggtcttgatgtcgaaaaggttggagaccatggcgagggcggtaccccactgtcccgcaccggtctcggtggtcagggtatggatgccggcattggcgttgtaatacgcctgtgcaagggcggtgttccccttgtgggagccgagaggactcatgtcctctcttttgaaatagatcttcgcaggggtcttgagatacttctcgagcctgtatgccctctggaggggggaaggtctgttcagagagatcaacgcatccctgacctcctcggggatgtcgatgtacctctccttggagagctcctgtttgattatgtcgtcgcagaagatcgctttgaaatcctcttccttcaccggctctttggtgaccggatggatcatgggctgcaggttgggcaggtctgccgcgatgttataccatctcttggggatgtcctcgggagacagctgaattcttgcatcttttggaattgccatgaacggaagattgcctatgtgtatattaattattgtacaatggtgcatttatttgtacatttaatattcatgccggcgtttactgtccccctctcccctctatctgtagtatagatatctcctatgatcgaagatatctcttgtatgggggcgccccgggccgatccgcatgtcaaaaacaaatctatttatagaagttctgtactatacaaccattagttgtaaaccgacggagaacaaccaagtgataacatgaccgacatggacagcatcctttccatagtggagaacccgacccggaggaagatcctccaggccgtggtcagggaaccccactaccctctgcagctctccaaggagcttggaataagccagcaggcggtggtgaagaacctcaacctgatggagagggagggcctggtcgtcagttaccgcgagagcagcgacaggggacccgacaggatcttctacaaaccgagctcggagttcacgatcaccatcgacatgcgcaacagcatgttcgagatgaggatgatctccaccggcgagaggatggaggaccggaagccctcctcagacgatcaagaaaacaagacacacgaggaacagaaactcgaggaggtccgcgcgaagatctccagcatagaccgccagatcgcggagttcgacagacgcaggtctgccatggtccgccagaggagcgatctgataaacgagttcctggacggcacggacctgcgtaacctggactacgagcaccgcgaactgctctacgacatgctgaacaggcccaattggagtgcggaggacatctcgaagagccttgggtttaacgagagcgtcgtctccagaatgatagacgacatattggatatgatgaacagagagtgatagacatggcagctaacgacagggcgatcaaggtcgcggaactcaaacccggagaggccgggaagggcgtagcaaggcttgaccccgagctgatggacatactcggtatcaaggtcggggacatcgtcatagtcacaggaaacaagaagacggccgtcaaggtcctgaggggggcacccgaggatgccaacaggggcatcatcaggctcgacgggtcgaccaggcgcaacgccggcgtatccatcgacgagagggtcgacgtgaagaaggccgaggtgaaagaggccgagaagatcaccttctcccccacggacgagctgagactgcagggcggggaagagtatctggcacaagtactggaaggcagggcgttcgccaaaggggatgtcctgtccctcaacatcatgggcaacaagatggacctcgtggtcacatccttcaaccccggagcagacgccgccctgatgacgtcccagaccaaggtgaagatcagcgacaaaccgatctccaaggagaacatggacatcccgaaggtctcctacgacgacataggaggtctcggaccggtgatcgggcagataagggagatgatagaacttcccctgaaacacccggagctgttcaagaggcttggcgtggaagctccaaaaggagtgctgctgcacggtccgcccggaaccgggaagaccatgctggccaaggccgtggcgggtgagacgagcagcaacttcatctccatcggcggccccgagatcatgagcaagttctacggcgagtccgagggcaaactcagagagatcttcaaagaggcggaggagaactcccccagcatcatcttcatcgacgagatagactcgatcgcaccgaagaggagcgaggtgcagggagaggaggagagacgcatagtcgcccagctgctgtccctgatggacggtctgaacgccagagggaaggtcgtggtcatcggtgccaccaacaggcccaactccatcgacgaggccctcaggagacccggcaggttcgacagggagatcgagatcggagtaccggacaggcacggacgtctcgagatcctgcagatccacaccagaggcatgcctctggataaagacgtggacctcggtctgatcgccgacaagacccacggatacgtgggtgcggacctcgcggcactgtgcagggaggcggccatggccgccctcaggagggtgctgcccgaggtgaacgtcgaggacgagaccatccccaccgaggtgctgaacaggatatgcgtcacgaggacgacttcacggacgccatgaaaggcctgcagccgtcgaccatgagggaggtgctgatcgagaagcccaacgtcaaatgggaggacatcggagccctggcggacgccaaacaggaactgaaggaggccgtggaatggcctctgaagtacggcaaggtgttcgcacacatgaacgccaaacctccgaaggggatcctgctctacgggccccccgggaccgggaagaccatgctggccaaagcggtcgccaccgaatccgaggccaacttcatctccgtgaagggaccggagttcctcaacaaatgggtaggggaatccgaaaaggccgtgagggagacgttcaggaaggccaggcaggcatctccctgcgtgatcttcatggacgagttggactcggtggtacccgtgagaggtaccggcggggacagcaacgtgaccgaaagggtggtgtcccagatgctgacggagatggacggactggagcccatgaacgacgtggtggtgatcgccgccaccaacaggcccgacatgatagatcccgccctcctgaggcccggaagattcgacaaatcaatcttcgtgggtcctccagacaaggaatccaggagatccatcttcggcatacacaccaggggcaaacccctggacgcggatgtcgacctggacgccctggccgacaggaccgaaggatgcaccggagcggacatctccgccatctgcaacgaggcggtcatgaccgccgtcagaaggctggtgtcccagggcaaggtcccggacgacgaggagatcgccacctgcaaggtgacccaggacgacttcctgaaggccgtggacaagttcggacccaaggccgccgagagactgaaggcctacggcgacctgggaaaggtcccgacggaatgatccgccgggaccccaaaccatttaccgggtcaatgacccagacataagaaaacgaggtgatatgcatgacagactacagcgatgctatgaatgatatgtggactgacttcggccgcctcttcgaaagcgacttcgcaagcatgaacaagaggctcaacaggatgttcgaagaccttacgaacactcccggggtcaagacgtacggctacacgatgtaccagggacccgacgggatcccgcatgtgcaggaattcgggaacacgaccaaggacgacggccttaacgcatccacccccttcgggatgatcgccgaacccctcaccgacgtggtcatcgacaacaacgtcgtaagggcgaccgcggagataccgggcgtgaagaaggaggacatcgtgctcgacggcactccatcttccctgacgatatccgtgaacaccgacaggaggaggttctcgaagaccctcgccatgccctgtgacgtggatatcgggtctgcgaaggccacctacaacaacggcatcctcgaggtcaccctcaaccccatcagaccgatggagcacaagaccaggatcaccgtggaatgatcttatccggggccggaaggccccctcattacctctgcgggggaggacggtttcccccgaccccatccattgatacggacctcccccaccctttaaaatgaccccgatgcctgcgcaatagtatttatcagacggttccgattacaatctatgcagcctgctatgcgcaacaaccaacttaccaaagaagagatagacgccctcctggggtccgagaacgagggggtcctctccaccaacggagaggatggatacccttacggcgcacccatcaactacgtctacatggacggacgcatcctgttccacggacgcaaggtcggagaaaaggtcggaaacatcaggagagacccgagggcgtgcttcaccgtcgtggattcccaaggcttcgagatctgcggggacgaggagatcaccaccgtctaccgctccgtggtcataagagggaagtgcaggttcgtagaggacgaagcggataagacccagatgctcagggcattggtcaaggcaaccgtccccgagaaggccgaccaactcctcaggcccgagattgtcaaggccgccgaggtctacgagatcgttcccgaatcggtcaccgggaaataccacaggcccaaggccggcaacccggtcgtgaagaaggactgaaacccttacatggcctccgccccccaccgttatgcgggcggaggtaccaacatctgattccgataggaatccacatatagatgtacaaatctactaacagaacatgacgagagaggaaatggtcaacacgacccgtgccattctggccaaagcggggttcgacgtctcctcggccatcaacatacgcagcatatgcttcgatgtcgtaggccgcagggacaagaccgtgttgatcataaaggtcctcggcaacgtcgacgcattctcccgcgagaacgccgacgagatgaagatcatggcggacgccctcgatgcgagccccatcctcatcggagagacatccagctccggcaaactggagaaggggatcatatacaccaggttcaagatccccataatatccaacgagaccctcgcagaccagcttctggaagaggtcccgcctttcatcttcgcggcccccggaggactgtacgtcaagatcgacagcgacaccctcagacagatccgcgaggagaggagcatcagcctcggtaccttggcggagaccgcgggcgtgtcgagacgcaccatccagatgtacgagaacgggatgggcgccatgatagacgccgccctgaggttggaggagttcctggacacccccataatcgaacctctggacccgttcgactaccagaaggacgattccgtgagatcccatgaggtctccggaaagggaaactccacagggttcaccccgttggaccgccttgtcaacatagggttctccataacgcccattttcagagggccgttcgaggcgatcacccgtgacaacgaccacaacatggtcctcctgaccgggatagggacggaggagagcaaactcatccagaaggcactcatcgcctccgaactgtccaacctcacccacaagcactccgtggtcatcgtccagaagaaacacagcacggacagtatcaagtcgaccgccctggtgacggacgacgagctcaggaagatcgacgacaagagcgaactgactgacatcatcctctcccggagcactaagaaatgatcgggatgaccgtcggaaaatgccgtgtcgacatacttcccgtagtcaacggtctggcctccgaggccgaaaaagtgaagcaggcttacggcggctacgacgcatatgccgcatccatggggatagagtccctcgaggccctgcgtaagagggagcagatcggaatggatgacatagaggtcagcgaactggacgtgatctatgccaagaagatgtccgagttcggagacatcataaccccgtcccccgcattctgcgagatagtagacctatgtgccagagacgggatcaacgtcatccccctcgacatgaacgattacgattacgacacagcatacatggactgcataaaggtcacagaattcacgtcggaacacaggctggcgaagaaggggctgaaaaagaagatggacgcatcgacccccgaggaacttgccgtcatgtgggacaggcacgtatccacggtaaaaggatacgggagactgagcaggaggagggaggagcacatggcttcggagatctatgacacggcgaagtaccggtcctcccttctggcagtcgtcgaggtcgaacgcgtcgaagggctggtttctatcctgagggacatggatggcgtctcctgaatgcgacaaatgtgaggagtggcgcagaaagggggccacgtattgcggggaatgcggaaggttcctgggtgatgggtgccccatgtgccagatgtggaaagacaggggcgccgcgttctgcggggaatgcggcagggcccttgacagaccgcctgcggaaaagaggaaagggaacatattccacacgatcataaaattcagtgccgcactgttcctgctttccgtcgtatgcgccctgctggcggacatagccagtgcagggaacatactggatgccctggaaaacaagagtttgggattctacatccctctgggtcttgaggacatagtcctgttcagactgtccgggacgggtctttccgcatacttcgtcatcgaactggccgtcataggtctgttcggcgcatatgcgacatacaggacgttcgccgtcaggaaggaatgcggagacgacccggaccgtatggcccataccgaccttagtgcggcggcctccatcctgtgcgtgacccttgcaacctctctgatctacctcatgttcatggccgccggggggcataccgccgacacttcatggatggacagatacagcaggtgggagatgatgttcatgctcaccaatgccggattgcaggaggaactcgcataccgcctggtactcatcgggatccctatggcggtcatcgcattcgcgaaataccgcgatgtgaaatgctggagattccttctgggcggattcgggatgagcaaagtggctttcatcctcatcctggtcagctccgccatattcggtctgggtcattacgacggatggggatgggtgaaggtcatcgacgcgttcgcaggcggcatactcttcgcctacgcatattcggaatacggtcttcacgtatgcgtgctcatacacttcgtcaacgacaccctcacccttttcccgggagggatcttcattgaattggccatgatggggctcggactgatcatcctcatatactggatcataaagcccaaccgctcggcataccgtttcacggatatgccttcgatgcctccccgcccggagggaaaggtcctcagcatgtgggaaagacattgaaaaaataagtctggcacatcacgggggaagaagcctcttcaggacttcctgggactcgacggcggactccagggatttggattctattatgtatctgcccttgtagggcctcagcttcctgatgacggaacggaaatctatctgtccggtcccgatggtcatgtggtcgtcattcacacccatgttgtcatgtatatggacgttgactatccggtccccgaacgtctcgatcatggcgtccatctgtccggatgtgttggcatgaccgatatcgaagcatatacccagatcggtcgggccgactatctcgtcgagttcttcggcggttatgccgagcatcacggggacgttgggcatgttctcgatggcgagcctcacgccgtactcggcctgggccctgtccagaagcctcatggagtcctgggccgcggctatgctcctctccctcgtccccgatacggcgagattgattatccctggatggaccgtgacggtgtccacgcccatctcgcaggcggactgcatctccgacattatctccatcatggtggcctccctcatacggggatttgtggccgccacgttggtgtcggctatggcggagtggatggagaacgtcattccgtaaggctccgcgacggcggaaaaagaagggcttatcttctgcacggagtgattcaattccgagaatatctcccaatgcctgaaatgactggatatccgtccgagacattcctcgaaccgttccttcccgaaacccggacaggataccccgacggtattcactgtttcacttcctccccgttgacggtcatcggcgccaccctgtctatgaacgcatcgatgtcgtcggcctccacggagacgcttatggtgcccaatacggtgcggtaatccacgaaggatatcttccctacggtggcgacctgcttgttcagactgaatacggtcctgttctttcccttacggacccctttctgcatctgggaacgtgcggtatcgaggatcttctgccttctgatgagctcggagaacctgtcaaggtctgcagggcctttcatctctccttctgcaagctcgaattcgccggtcggaaaaatacccagaagggctgccttcaccttatctgggtcttcgctcggatacacggggcacgacaccgtcacatctgccatggttctatgaaccgcaagcaggtattaattggattcctatgaaaaagacatccccgggacatattgaaacagcacaacggctttaatcgggattgtgattgggtatacgtatgcaaaaagacgaggtgctgtcggcagcggcgaagaggaatcttttcctttccccggacgcgttggagataatcgattccaacggatgtcccatggaattcgtcaacacgctgctgaactcccttgcaggaaatacgatgttcgtcaccaaagacgacgtcgtcaaattcctggaaggggagaaggccctcatggaatcccagaagacgatcgccccgaagataaaacgcgatcccgacctgaagatcgtatccggttcggacatcacgggagagagtacctgcaccggcaccatagaggacttcgccaactacttccgcagcagatacaccctcctcaagaagatcatcaacaagcggaaggatttcggaatgtccatgtccatcgaacgtgccaaagagctcggcagggacagcatgaacatcgtcggcatggtctacgagaagaggaccacgaagaccggccacaccatcctgacgatcgaggacgagaccgacacctgtgccgtattcatatccaaggaatccccgctggccaacgagatgttcgtgaatgacgaggtcatcggcgtcaccgggaagttcaccgacagcaagggcctgttcattcccgagaccatcgtaaaaccagatgtcccagcagggaacaaatgggtcccgtccgactccacatcgtccgtagcgttcctttcggacatccatatcgggagcaaggaattcctgaagagcgactgggagaggatgatcgagtggctcaagcataacgccgacgaagtaggactgaactacatagtcatgtccggagacgtggtcgacggcataggggcctatccggatcaagagaaagacctggagatcatggacatctacaaccagtacgaaaccctggcggaatatctgaaggagatacccgacgggatcaagatggtcatccatcccggaaaccatgatgcctgtcgtcttgcggaacctcagcccgccctttcagaagtctataccaagactttcgacagcagcataatgatggtcggcaaccccataaatctcaggatagagggcagattggtcacatcgtatcacggaaaaagcatcgacgatttcatcgccggagtcagaggactgtcgtacgacaacccaatcgccgtcatgaaggagatggtcaccagaaggcacctcgctccactttacggcatgaggaacgccttggcaccggaaaagaaagactacctcgtcatggaggaggttcccgacatattcgtcacaggacacgtccacgggaccggaaggatggattacagaggggtgaagatgatcaacgcctccacatggcaggcgcagaccgattatcagaagatgcacaacttcaatcccgaaccgtccatcatgcccatagtcaatctcggtacgggcagcgtcatgatgaagaatttcaagaaatgaacgtccgacccatatcgtcatgcgggcatagacatactgcacaatggttctgtgaaaaactccagcgtatacactgaagcatgcattttccaatccagttgacggggcgaaagccccgtctttggattgtataagttgtttaccggtgtcagaaccgttccgtgaagatcacagcaattatgatgaacgctccgagcataagcatagcgtacgccacgacccatatcgcagtgaaggcccttttcagctttttcgggtcttcccggatatcttctaggcgatcctctatgcttttcctcactcggtagccgctcctttcttcttgatgtgcttaagacgggtggtgttctccctctccatctcctcgagacggaacttcacgaacctctccgactccttgaggtcggggatgatcttgaactcgagagcgttgacccttctcttggtcttctcaatttcgtccagcagcttcttcatggtggtctcgacctcggcggcgcggatcagggtctcgagaagtttctcgaaagatgccgcggcctcctcgacgtaggcagaggtatcgagcacaccgtaacccttgttcaggatgtcggtgtggatggagtcggcctctaccttggggaccatcattcccatgatggatttgctggagagcttgacggtggggtacttgttgagtgcatatgctgcactcctcacgttgacctcaccgtcgatagcccttgcgatggtgattttcttcatcgcaacttcgaaatcggttgcaacgccggcacgcatctgcctcgccttctccattacctcgaagaactcgatgatgaggccgtccctcttcatcttcaggatcttgtgtccggactgggacagtttgatccttctcttgaggtccagaagtacggagcgggtcggggtgatatcgtgggctgccatgatcggttcactccttcttcgggaggtacttctcgatgtacttcttgtcgatcctggtcagctggtcgatgtccagctccttcaggatgtcccaagcgatgtcgagagtcgtctcgatggaacggtcctcgtcgattccctggcggaccacacggtcctcgaagaggtcggcgaagtccaggagcttcctgtcttttgcggacagggagtcctttccgacgatggcgacgagtcccctgaggtcctttccttctgcgtacgaagcgtacagctggtcggaaacggccttgtggtcgtcacgggtcttgccctttccgataccggagttcatcagcctcgacagagaactgctgacattgaccggcgggtagattcctgccctgtggaggtccatggacagaacgatctgaccctcggtgatgtatccggacaggtcggggatcgggtgggtgatatctgctccgggcatggtaaggatggggatctgggtgatggaacccttctttcctttgatccttccggcacgctcgtacagctgtgcgaggtcggtgtacatgtaaccgggatatccacgccttccgggcacctcttcacgagctgcaccgacctgacgcagagcctcacagtagttggtgatatcggtcatgatgacgagaacctgcattccgagctcgaatgccatgtactccgcggtggtgagtcccagacgcggggtggcgatacgctcgacggcagggtcgtcggcgaggttcaggaagacgacggcgttcttcagggcaccggtcctctcgaactcgttcatgaacttctgcttctcctcgttggtgataccgagggcgatgaacacgacggcgaactcctcgttctctccgcggaccttcgcctgccttgcgatctgcagcgcaatgtcgttgtggggcagaccggaagcggagaagataggcagcttctgtcccctgaccagggtgttcattccgtcgatggtcgagataccggtctcgatgaaatcggcgggcgagtcccttgcccaggggttgatggctgcaccggcgatgtcgagctccttctcaggaacgatcttggctccgccgtccagggggtctcctgctccgttgaggacccttccgagcatctctttggaaacaggcatcttcatggtctcgccgaggaagcggacggaagcggacctgtcgattccggtggttccctcgaagatctgaacgacaaccatgtcgtcggacgagtcgagaacctctcctctcttgatggatccgtcggaaagcctgacggaaacgagctccttgtatccgacgggctcggtcttcttcacgaacaccagaggtcccgcgatctgggagatagtcttgtactctttagctacggttgccattttcaagcctccagtttgctgaactgctcgtccatgtccttggcgactgctgcgagctcctcgtcgaccttctcctcgtacttggcctgctggaacctctgcctgacgggcaggtaggcaatcttgtctaccgctacgccggtcttgagggccttgtcggccaggtcggagtacttcttgatgagcttgagcatggtgtactgcctgttgagggggcagtagcagtccacggggtggtatgcgttctgctgcaggtagatctcacggatcatcttggcgacctcgagagtgatcttctgttcatcgggcagagagtcggatccgaccatctgcacgacctcctgcaactcggactccttctggagaactcccattgcccaggccttgaggtcggggaagtcctctccgacgttcttcttgaaccagtcggacagctgcttgtcgtacatggtgtacgaggtcagccagttgatggtcgggaagtgacgcctctccctgagtttggtatccagtgcccagaagacacggacgatacgcagggtgttctgagtgacaggctcggaaaggtctcctccgggaggagagacggcaccgatgacggagatggatccgtcgtcgccgcaaagtgccttaccgcggcatgcacgctcgtagaactcggaaagcctaccggacaggtacgcagggtatccctcctcaccgggcatctcttcgagcctggaggagatctctctcattgcctctgcccacctggaggtggagtcggccatgagagcgacgttgtatcccatgtccctgaagtactcggcgatggtcattccggtgtagacggaagcctcacgggccgcgacaggcatgttggaggtgttcgcgatgaggatggtcctcttcatgagggactcaccggtcttcgggtctttcagctcggggaactcggtaagaacctcggtcatctcgtttccacgctctccgcatccgatgtagacgacgatctctgcatcggagtacttcgcaagggactgctgggtaacggtctttccggtaccgaatgcaccggggattgcggccgctcctccctttgcgagggggaacatggtgtcgaggacacggagtccggtgaccagcggtacatcggggttgtatttctcggtgaccggcctaggtacacggacaggccatttctgcatcatggggtactcgacgccgtcgaccttgacgatgggctggtcgacagtgaaggaaccggatttgatgtcctctacctttcctttcttcacgttcgggggaagcatgatcttgtggaccatcggaccctcctgaacggttccgacgacgcttcctccctggacctcgtctccgaccttcacggcaggaacgaagtcccatttggtctctctgctaagtccaggtgcggtggctccacgtccgatgaagtccccggtcatgtccctgagcacggggagaggcctctggattccgtcgtaaacggaagtcagaagtcccggaccgagctcaacggcaagaggcagaccggtgttggtgaccggctctcccggtttgataccggtggtgtcctcgtaaacctggatgatagaatagtcgccaacgatcttgatgacctctcccatcagtttctcgttccctacgtgtacgacatcgtacatcctgggagagataccggtggcggtcacgacaggacctgcgaccctgtaaattacaccctcagtgctcattcattcatcctctgtcttgtacaaatcaacgccaataaccttcttgaccttctcgcgaagatcgctctggtcaccgcctacagggacgacgacgggctggatggaatccaggaccttcgtcttcatgttggcgggcagatactgcaggtcttccgcattcactgcgaggataccgatattggcatcggcgatcgcttcctgcattttttcctggtaattgctcttatcagcaacgaacacccttctgactccggcaaggcggaatccgagggtgaactcgtcgctaccaatgactcctatctccatcagatcaccagcagtttcttcatggtgtccctgtcgagaccgctgtcggtcccgtgggcgatcattctgatgttcctgacctcgttctccttgtggatcatgtagtccacgacgggaatgacggagagggggtacatgtgaccaaccttgttggcaagttctaccctgtacttgttgatcacacccacgacgtccaggatggttgagtcctgggatagcgagtccttgatttccgaatacatcctgagttgctgcatctcgttgacggcggcctggatgtcctgtgctgctgcgagctgggacatgaccttctcgtcgacctcggtgcctccagggatccagtactccacgacgacgtcgccggttatcccgtctgccttgaacttcaggacggtctcgacattcttcaggtcgatgcacgtcttgatgtaggtgcggaatatctgcgtgggtctgtcgctggaacttatggatgccagcaggttcttgtagtactctttgacgagcacgtcctcgatggaaccgaggataccgttggtcttgtaggaggagatcacgtcgtcgggtacgacgatgtggatcttcttcgagaatgcggccaagatgtcctcgatcgtagtgagggagagcatcttgtccagatcgtccatggagaggtttccggcaggaacgaggtcctccctgatctcctcgatgggcagtccgtattttttgccgcgcatgatggtcttgagattctcgaagtcccacttggtgagatacgcgttgaccatccgactcaatgctccggtggaggagttcaggatgctgcggaaggctttcgccatgttggcatacgtagcgtactctacgagcgagagcccttcgtacctgtttccgaggtcggccatctccttcgagtagcctgcgtcgctgatgtagtgcgagatctcgggaacagacatcatgagcatcttgttgtagtcttcttctttgaggagcttagacttcttcgccttcaccctcgcggaagtgtacgagtagttgcctgctccgctgcggttgaacattcttcttcacccgaacagtatatcggacagttgcttcaggttcttgtcccagatgccctggaggatcacgcggaactgcatgtctacctcgacggatccgtcctcgctctggagcaggagtccggaggagacgcgggcgtctttctctacggacttcactccgaggtcggatgcgctgaagtcatcgttctcggacatgatggccttgggctcggggatgatggtcttcgcggaagccaccattgccttgtagtacgtcagtttctgcgcttccggcacgttctcgagctccgcgagggcggactcgaaagcctgagagagaacctccttcttctttgcgaggacgagcttcttgctctccagctccgcgctggaacgctcctgacggtcaagggtctccttggcttcggcgaccttcttgtcctgagcttctttcattttggcgatctgggcgtcggtctgcttgttgatagcatcgatctccgcggcctgctcctgacggatcttggctacggaggcctcggcagacgcctggatctccttcgtcacgctgtctagtgccatatgaaggcctctagaactcacaggacgaacattgccatgacggcgacgacaagaccgaagatgacgatagtctcaggcagaacggtgaagatcattgcccttccgaagagggaagagtcctcggtgattgcaccgactgctgctgctccgatgtctttctcacccataccggttccgataccggcgagtccgactgcaagtcctgctccaactgcgataagtccactagtgatgtctgctactccagattctacgaccatttcaatcaaacctctttaattgtgcttgtttttttgctgaaaaaggttttgacacgcttctctttgagaggtgcgaacttctttcctcctccgtcgaagaacctcatcatgagctcgacgtactgcagccttagagcgtgcagacctgccgagaggattccgagggtccaaacgaccagatgcaggaatgcgaacattacgatcgcgatgatgaccatcactatgccggacgagtagtccagatagatgagcccgtccacggtgtggctgggtatgatcatcttaaagatgatgtagttgaacgcaagggccataccggccttcgacatggcgatagccgccagacgagtgtaggacaggatctgcccgatgatctcgggtatacccatgacggcctgcattgctccttccgccttggtgtttattgcgactcccgcgacgatgcagacaacacccagtatcagagtgatgaaggtgataccctcggtgatgctggcactgttgaacatgaaatcggtgagagcgtagcacaggaagatcattccgaagaaggagaagatcattcctcccttgtggatgaaggcgaacttgccgcccctctggatcagcatgttgtacaggccgaccagctgtccgataaggaggtgcacgataccgatgtacacggacatcttgagcaggaatccgacgtcttcgagttttccgactccctcaccgtgcgctacgttgggcatcagctcgtagaaccagtcggggaaggttactcccagaatccagtcccaggtgatgttggttccgtcgttggcggcactgtcggaataccactgccatatacctgcggcgttgtattctccgccgatgaagtgcattcccagcatttcaccgtagtagaacataccgaagatagctccccagattcctccgaagaacaggacgagaccgatggagcgccagtctttgttcttggcgtacttcagtccgtaggctccgatgatgatgaagggtatggaatacccgatgtctccgatcatgtatccgaagaacagaggcaggaatatggcgatcaggaaggtcgggtcgatctcctggtacttcgggatgtcgaccatgctggtcgcatactcgaattcgccgacgactactccgttgttctgtttcgtcggaacgttcttgaaacgaggctccgcgttctcggaatcttcgagtttccttccgcgggtctcctggaactccacatagatgtcgtccccgagcttctgctcgaggtcggccttgatggcgtccactttctttgtaggtacccatgcgtccatgacgtatgcgtacttgctcaccgcgatcctgaggggaacggatcccttctcgacctcgatggacagctcttcgtcgcttcctttcaggaaggacatgtatttcgttttgagagcttcaagcgtcttgttctccgcctcgagggcctcggtcgcctcggagatctccgagtctaccttctggcacgcctgctccgcggacaccttgtcggtgtactcgggaacggacagctcgacgaagccgcactcgttaagggcgtcgacggccttgctcttcccggcagccttgacgaagacggccacgacaccgccctctttcttgtcgaagctggagaagacctcggcgtcgtcgatcttgacggccgcggcatcggttacggttgtaccgacgagaaccgccaccgacttgtacccgctgtagaggtcaagcgtcagaggcagtttcttcagaatctcaaaagtcttctttttagagtttaattcagtgattttctgggtaagatcattccttgcgtcgacggtcttcaggacctcgtcttcgacgctctcgacctcgccgtcggcgatgcgcttctgcacatcctcgaccgcgatgtcggcggtcttggtcttctttttgatccccagctctttttccatcgctttgatcttcagcagcctctcggatgccttggaagtcccctggataggggaaccgatggagagcccgtcgtcgccggtggtatgatcgatcacgtggatagctttctcgctgtagaatgcgttgatggcatcctccatgcgggtcttcgtacccacaatcacaatcctactcatcgactcaggaagaagcatctattgccctctcgaattctttcgtgaggaaatcgttgacttccttgatcttatccttcgcggcgttctcgatctgagaggcctctttctcgccttcggcgagcttagctgccttctcctcatcgagaatcgcctgctccgctgccatagcggactcgtaggcggagcgctcggcggcgctctcttcctgaatcctcttgacagaatccctgcgggcctgagccacagcggcttttttatccgattcggcctgtgcgaccgtctcgtccgctctggactcagcctcctttatttccgaaagtatgtcagttcggctcaaattacactccccgactattcgtgggagtttgtatccgcctaattatatttaataggcatcggtcaatccaatctactgtttataaaagaagaacccagaaaatccgtcgtttcgaatatttccgtgataaggtttaataatcacctgtctcgcgagtctcttccttcagaatggaatccacactgtccgcctctatccggcggatcctgatgctggtctcggagaggatggatttcgacaggtcgtccatgtacccctcgtcgtagactatctccgttatcccagagttgatgaggatcttcgcgcaaagggaacacgggaacgtggtggtatagagggtcgcccctttgacgctcgtcccgaagtatgcggcctgtgcgaccgcattctgctcagcatgtaccccgcgacagagttcatgcctagtgccagacggtacattcatctgtattctcagacatcccgtctcctcgcaatggcgcgtaccgcggggggctccgttgtatccggtggacaggacgtgcttgtctttcacgatgaccgctccgacggcacgtctgagacaggtcgagcgggtggctgcgagcttcgccatgtccatgaaatatttgtcggcggacggtctttccatagacacgtcattgtcccagaggcataactactttattatcggaaaaaacattcgtcctttccgtgaagaaggacacccgtaacttcgtgatagtcctggcggtcctcgtcgcgatccttgtcggcgggaacatagccgtcagggaatcttccggagtggatcctccgttcaccgtagtggaatcccagagcatgcagcatgggaacggatccgagataggcatcatagacaccggggacatggttcttgtaaaaagtcccagtaagacggatatagtcagttatgtcgagggctatcattccggatacaggtccttcggagaatacggatccgtcatcgtgtacgaacgttccgtcgggaatcccgtcatccaccgtgcgatactgtggctcgagagcaacggtgacggaacatggtcggcagaatcgctgaaatattataccgatgacggaagcgagacgggcaccaggatgtggagctgcagtctatacaacgactacctcaacatgtctggcacattgacattgtatgatgtaggatatgccgggaagatagtgtcgataaatctagataccttggataacggcagaagcggatatctgacgatgggggacaacgccgtcaccaacagaggtttcgatcaggtgataggcgtatacggagacctggtggccgtcgagaacatcagatccgtagcatgggtggagataccatggctcggatcgttgaaactcatgatcaacgggaacacctcggccctcgatacatgggcctccaacagcatcggatatctggctgtcgcgttcgtcaccgtgataatggtgctgatggccataggatacacatccgactgtcttcacatcaagaaggcgaagaaaaggtgaccgaaccgacacctggaaaacatgtgccagatgtcagagtgtctcctctatcctcgcctcgatcttttccggagatatgaaagaactgaacctgtccgtgacgttcccgtccctatcgaccaggaatttggtgaagttccatttgatatcagagcctgtgagtctgttcttcttctgggacttcaggaaagtgtacaaaggcgattcgttatccccgttgacatctatcttcgagaattgtctgaatgtgacatcgtatctcgacctgcagaactcatggatgtcgtcgtcgctgccgggtgcctgcgatgcgaactggttgcaggggaagtcgagtatctcgaaacccctgtccttgtattttttgtagagagcctccagcccttcgtactggggtgtgaaaccgcagccggtggcggtattcactatcagaaggacctttccttggaactcgtgcatatcgacggattttccgaagatgtccctgaccttgaaatcataaatccccatgtctttcgcctcgaagaagaccacgatacaggatgctaaaatggtttgcgaaaaatatggatgggttttgttatcgagacacccccaccccaccatttccagtggaactcggaaacgaagtgtcgtgccgaaaaaacgacgacacaagacccccacccctctgtttccagtggaaatactgtaacgagtatgcgcgaaaaaaatcagacatccgtcacatgagagtcgtctgttttttgagtttctgattgagattcatacctctgaagatatcatcggaactcaggatggagaatacatcgttggagaccttgttcacatcgatctccttggtccttcctccccttccgaaggatttcacccttgctgtaatgatacccaacatatccatctctgatatcagattggcaaccattctttgagaaagaggattgtaaccgagattcttactgagttccacatatgtcgtgtagacctctcccgttgtgacagaaccggtatcattggaagaaggggtctttatgatactcataagcactatcttagattggtccgtaagagtctttatcacttccaccacggcatccaattctatcttctgccttgcatagtctacatgagcagaagtcactatggagtctccgttcctttctgctatatctgcagatattctaagaagatcgagagcttttctagcatctccggagccttgtgcggaaatagcggcacaatacgggatgacggaattatcgagaacattaggataaaaagcctgttcggccctgttcttcaaaatatcgataagttgttcgggagtatacggagggaatactatcttctcttcaccgagtctgctccttatcctaggtgaaaggaatttctccgcaaatgtggaattgttggttatacctatgatggagaccctcgaattcttaagcatctcattgatggtcgtgagataatagaatatgtcatctccgttcttcttgaatgacatatctatctcgtcgagaacgactatgaatatcttgttctcgtcatcgatgtaattggcgagttcgttgaatatcttctccagactccatccggtgaaagggatcttcttattcggatccgttattatctggttggatatgttgtataggatgctgtagggagtgtcgatcacttcgcagttgacataaatatacctgcagtttttgttctctgcatcagctctttccaattcatgacctacataattcacgacagccgtctttccggtaccagtctgaccgattatgatgatgttggatggtttgtctttattgagtgaaggagcaacgatatctacaatctcctcaatctgataatccctgtgaagaagtacatcgggaacataggtggcttggaggatcccacggttcttgataagattgtttttcttttcaagataccttttgaatatagaatccgccacttgaaacacctcttattcgcgtagaacttcctaacatgacacccacatataatgtttctctaataatgaaaaatcgattattcaaaagatatagtccgtgtcgtttccgttggattcgtttcatttttaaatcatctgaaacgaatatttaataaggatatcggatatgtttccgtaatcaggagacctctaaatgaaaggttatctcactatcgcaggctgcattgcggcaatcgtagttgccatcgtcgctttctgggcgatcggaaacttctgctaaacgaattaactcaatttttcggcgtttcctaaaggatcgccaatctcttttcataaagtgtttatttcaaatattatcaaatatttttatccttattatttgaatttaattatcatacttatctgtctgttctttattttttcatatgctgggtatgttgtttttctttttcatggaatacttttcttctaaaattcagtattatctttttatcaaattttattatcaattttcggtatgatctcttttttccagttccactggaaacagaggggtgggggtgtgtttttttcgcgcacccggatagaaatcgggttccagtggaaatggtggggtgggggtcttcgaaggactgcatgtaatagatatccattaaaaacgagaaagacggacccgttccgatgccatcattcgtgaaagacaaatatttccttctttgtcttgcagcagcattcatcctgttatgttcctcttttgacaacgatatgacggataccaaggagataggcatagtatacgaaataaccgaatccaagaacggtttcgttttttgtttcgaaaatacagacggagaaaagatgcgctgtttttcgcgttcggaacccgaagaaggttctgtctatgagatatccggaaactggtccgatgacggaacgatgtttttcacagattccatgacaaaattatcataatcgcagcctcatcggtgcatccatgttcgtagccgcggacgatacggattccatgaggggtaactgcacgacctatctcgccacagagataatccgcgagctcgtaatagacggcgatctcgatctgatagggttccccagactcgtccgtctgaatccggcgatcccttggaagaccagagggaacggttccctggtcatgagattcggaaggggagtgggtaacaagaccttcatcggacagatatccgggaaggacctgttctgtttcgaagaacaggacgattgggaacctgatgaagattccatcctggaaaagatagtcccgctggtggaaaggttccatgacccagtggattccgatccggggatcgtcgtaagccgcacgagaccgtcctacgacttttatctcagaggcgtgaggaaggtcatgaaacgctcggacatagaggccgagatcgacaggataggtgccaagacgttcgtcctcggatgcggcagaggacttatcggatgtatctgcgggatggcctgggtgcctaaggatttcacatacgagctgcttgcctacaggccgcaggagagatgggggaccgagagggttttcgaccctggatccatcgagaaagcggaccacgaaatttccacttcgttcaacagttgggaggaccggttccgtaaggtcgcgatggtgcccgggacgccgtgtccggtcatgtatggattcagaggagacgatgtgccagatctgataagaggacatgatattatcaagacggaaccacaaagcagatgggtggtcttccagaccaatcagggtaccgacgaccacatcataacagaattctctccggaggagttcataccgaacagttcctatctcatcaagggaacggtcgtctccgtcgaacgcatccgcggaggacatactttcgtgaccctttccacggatctcggcgacgtggtatgcggagcatacgaaccctcccgtgagttcaggcgcgcattggattggctggttaagggggacgagatagaggtcatgggcgagctgagggacagtccccgtaccctcaacatcgagaagatgcacgtcctgaagactgtcgatgagttcgagaaggtatccaatcccgtctgtccttcatgtggaaggaccatgtcgtcggtcggtaaagggcagggatatcgctgtaagagatgcggtaccagatcggacgatccggtggtcaggaaatgcatcaggtgggtggtgcccggatggtatgagccgcctacggcagcaaggagacacctttccaagccattgaagaggatgggggagatacagcctgtagagttcgttgattgccgtaatccataaacgacaccattatatactctgctctgcgaatcgggaccaatatcagaagggttccccatggaagaggcagtaatcataagcgcatgcaggacagcgatcggaaaatacggaaagaccctcaacggcataaaggccaccgacctcggtgcacacgtcgtcaaggaagcggtcaagagggccggggtacagcccacggatatagaggagtgcataatgggtaacgtcctctccgcaggtctcggacagaaccctgcaaggcaggccgccatcggagcaggactccccgtggagatcggttcgttcaccgtaaacgccgtctgcggttccgcactcaaatccgtcatgcttgcagccgatgccatcaaggccggcgagtacaacgtccttgccgtcggaggtatggagagcatgagcaacgccccctacatcatgaacggtgccagatggggatacaggatgaacgaccagaccgtcgtcgactccatggtccacgacggactctgggacatattcaacaaccagcacatgggattcaccggggagatcgtcgccgaaaggttcgacgtcacccgcgaggacgccgaccagctctccgtggagagccaccagaaggcccacaaggcgcaggccgccggcaaattcgacaaagagatcgtcccttacacgatatccagcaagaagggcgacatcgtgttcgacaaggacgagggtatccgcgaggattcctccatggaatccctcgggaaactgaagcctgttttcaagaaggacggtatcgtcaccgccgggaactcctcgcagctctccgacggtgcttccgccctcgtggtgacatccagaagctgggcggaggagcacggcatcaagccgatggcatccatcgtctcctacggcgagagaggcgtcctccccgagaggatcatggaggcccccatccccaccaccgagcacgtcctcaagaaggccggaatgaccatcgacgacatcgacctcttcgagcacaacgaggctttcgcatccgcatcctgtgcggtcaagaaggcactcaacgtccccgacgagatattcaacgtcaatggaggagcggtcgctctgggacatccgatcggatgctccggcgcccgtgttctgaccaccctcttgtacgccatgcaggacaggcagaaggacgtcggctgcgccaccctctgtctcggcggtggtaacgccgtcaccatgatcgtgcgccgcgagtaaacatcatcagggtcccgtcggaagacggggcccgttatttttcacaaatacttaatacggatttccgacgttatcccgcacatggacctaaggggtattctggacagtatagacggttcccgcgaggatattgccaagatgatgtgcgagatggtctccataccgtccatatcccctgcggcgggagggaacggtgaggctgagcgcgccgatttcctcatgacctgtcttgacggcttcgattccatcgaaagggtagatgtgccagacaagtcggattcgaagatcctgaggtccaatatcctggccaggaagaacggcaaggacaaggggaccgtctggataatcgcccacatagataccgtgcccgcaggcaatctggacgattggaagaccgatccattcaaaggcgtctatagggacgggagggtctacggccgcggaacggaggacaacggccagtccgtgatctcatcgatcttcgccacgaaattcatagagaaggggaagttggaggggaagtccataggcatagcactcgtggcggacgaggagatggcgagcgaatacggcgttgtctacctcatagaccacggatatttttcggccgacgacatattcctcgtccctgattggggaagtcccgaaggaagatatatcgaagtcaacgagaagagtctcatatggctgcagttcgaggtcaccgggagatccgtacatgcttcgacccccgataaaggggtcaatgcgttcaaggtcggtaccgcactcatcacggatctcgtcaacacgttcaacaagaagttcggatacgaggatccgctcttcatgcctccgaggtccagtttcgaacctacgaaagcttctgctacggtccttaacgtcaataccataccggggtcatggtccttctgtatggacatccgtgtcgttccgaagtacaacgtggacgaggtgtacgaggtggccaaggaggtcgtggccaaacacatcaagtcgacaaacgcatacatcgaggtcagggagatccagaggcacatatccggcgggccgtcctcccaggaatcggatacatacaaggctctctgttccgcagtggagtcggtcacccgtcacagacccaaagcggtagcggtcggaggtgccacatgtgccaactttttcaggctcaagggatatgatgcctacgtgtgggagtgcggaggagggacccttcacggacccaacgagtatgtggaactcgataacctgatcaccgatgcgaaggtattcgccacattgttctacaacatctgtgtgaatagatggaatggggataatgtaaattgaccgggtcaattaattaaatgcgcgtatgcatgcgtatatcatggtcaaaaagaagggatcggaaggccatgggatactgacttcgtttctgggtggtttcatattcaccttgatcctcgtagtagtcatccccgtggtctgcaatcattacatccagccaatcgtggaggacgcagtcggggataacgctttcatgtggttctcgtcctcgctcatagtgaccctgatcatgttgggcttcatgttgctcttcatgatcgttttcggtggcggagcgattctgaagaagttcggcatcataggcgtcattgcgctcatacttgcatattgggcacttggaaaccttcccggagcgatactgcctgtggcatgtatactaatcatgttcctatggcaacgccataaagataggaattaaacaaaaaccggggcttaacagccccctttatttattcaagcctcggcttggtcgaagagtctctcgagcatccaatctgcatcgaatttcgagatatcctcatattcctgaccgtcgcagacgaatgcgatgggttttccgatggtctttgcgatggatagtgcggcaccgcccttcgcatcggtatcgatcttcgttaggattatggcgtcgactccgatggcctcgtcgaaaaccttggcctgctcgatagcatcgtttccggccaatgcatcgccgacgaagatcttcaggtcgggtttggcgactttggcgatcttcttcatctcggcgatgaggttgttgttcgtctgcatccttcctgcggtgtctatgagaacgacgtccctcatcttggagcgggcatgttcgatggcatcgtatgcgacggatgccgggtcggcctcctgctgagatttgacgatctttatgtcgagtctgtcggcatggaccgtgagctgttctatcgctccggctctgaaagtatcgcaggccgccagaacgacgcttttcccttcgcccttgagcctgtttgctatcttagcgatagccgttgtcttaccggtcccgttgatcccgacgaacatgatgatggtcggcctcttctgttgctcgatccatgcatcgaaatcgaattcgttcacctggaggacatctccgacggattctttgacagcaagctccaccacttcctcgagggagtattccctgctgtatttcttcccggagaggttgttgcggacgccgaggattatctcctggacgacatcgtatgcgacgtccgattccagaaggatcacctcgagttcgtcgaggatgtcgtcgagggggtcatccttgatctttttgcccagcaaggacgtgctgagcatctgggaagacctctttccctttcctttgacgggtttcgcaggcttctcttccggttcgggctcctttttgacaggaagcggttcttctttgcgagcgggctcggccttgacctctttcggaggttcgacagtctgctgctcaggaacctccgtctccttttccgttgtcggggagacgacaggctcctgtttgggctcctctttcttgtagacggattcctcgtcgagcgtgctgcctttcttgaaaatgcttttcagcttcgcttttaaggaatcgaacatttcacatcactgggaggggacgccctgctgctgcattcttctcttccggtactcgtcctgaaccgctgcggcgagatcctcggtgtactgctggatctcctgcatggcggctacggacttctggatggcatcgctgatctctgcggagttccggtccatgaaatccttggcgtcggagtattccttatccacggatatcttgttcccgatgcctacgacggctgtttttttgtctgtgaccttgacggtcacgaacgaggatgcaccgatcgggatgagtacctcgtccccttccttggcatccgccagggcctcgagggtcctgctggcccggacggtctcgtccctggatgcctgaagaagtctgatctggcgggagatgttctcgagctgctggttgtagctgtcgagggtccttgctgcctgacggagctcctcgtcgttcattttcaagcaccgatctggtactttacgaggtggctctccaccttgtctgcggggatctcttcgaccttgtcgatcttgatctgccatctcttcatcttgtgcctgcttccgatggtggagagggtcttctccctgacggatgcttcgtcctctgcagccatctcgatggagaagggctgttctttcctggggtccgcgaaggaaccggtaacaaggaatgctttcattgtgattacctaggcgagaccaacttataattaataaataaaggttgtgcagacccgcgcgggcatgtcacccgaacagcctgccgcttctctcgctagcccatccccagtcggcgtatttccttccgatgaggaacggggcggcatattcggggacctcggtctcccccttcaggacgaggtgctctccgaggatgtccaagtccatgtccttcctcatggtgaccttgaccgggtcgtcggtatagacgtccggtacggcatactgcagagggtcgtagtccgtgagctgttggcgggttatgtgggagacgcgcagacccgtcttcccatgcaatgacccagggagacggatcagtctcttgatgtcgggggtgacgggtttgtcgacctcgctcgacatgagcggtgcggcgtctgcggcgcacttcatgaggatctcctgttccgtagaggtcaggtcggccatggaattccgctggaacatgtccttttcacattttctcaaatggtcggacatcttcgcgagcgtggggttgctgctcttcacggacgggtattttttctttatcgtcttggggtcgctctcctctatgtccttgcagatctccgccagggccctcctcatcttacgcttccatccgccctcctcctcggagggtatcagacggtatgtgtgcacattggacaccgtcgtcccgtccccgcgttcgcgggccgatgccacatacggtttctcggggaatacccagtcgaggttcaggccggtgcaggagatgtagtcgaccagctccctcctctcgtgggtccccagggtgaatatgtcgttggaccttatgtgggcgtggtaccccctgcccccggagaagcatatgtggacctggtcctcggagaaacccaggtcgctgaacagatagtcgtcgcagagggcgatcatctccttcctgatctgcaccatcatctccgcatacgtcatctcgtccgccccggcaagatggtccgcatcgaggtcgaagatgagttccgcacccatccactccttgtcctccatcaccggtttggagggatagcgatagtaggatgtcgaataatagctatgtgctggcactttgcttgccatgaagatcttgaggtcgtcttggctggtgaacgccatatgcctctgcatcgtcttcccgaaggggatgaacccgaactccttgcgggtgaacctgtccggcatctccggtctgaacgagcggtagtaccgtctgaacatcttgaaaaggaaacggttgttggcatccaacagcgtatctcccggggtctcgcccttcgcaggttccatacggtctgccatgcacgtggtgtttaattaaaggtaggtcgttaatcgggcatggacccgcttccggtatacgataaccacatccatatgagcccgcacgggaggaacgtggacgccctcagggattataaggcggccggggggacggcgttgaccctggtgacgctcccctacccggaagtgcatatagaggacggtccggattttgcgagatcttatgagataaccttcgatctggcacataaggcaagggaggccaccggcatggagatcaacgtcgccgtcgggccctatcccgtcctcctcataggtcttgccgaggcatacggtctggagaaggccgaggacatcatgatggagggcatggaggcggccgggaaggcggtggaggaagggagggccgtcgccatcggagagatcggccgtccgcacttcgactgtcccgaggacatatgggacagttccaacaggatcctgaagagagggatggagatagccaaagagaacgatgtaccggtgatcatacactgcgagtccgggaccacggagaccaaccgcagtctctcggacatagccagaagtgcaggtctcgaccccgggctggtggtgaagcactcgtcgcctccgttcgtcgccgacggggagacgtacggggtgatgccctccatgcccgcatccaagacgaacataaaggaggccctttccaaaggtaccgacaggttcatgctggagaccgactacatcgacgaccccgcgaagcccagtgcgataatgtcagtcaccaccgtccccaacaaggtcaaatggatgctggcgtctggcacagccgacgaggagacggtcttcaggatatgcaaggacatacccgactctctgtatcgccgttgatggagacatttgtttattacttaggaaatatttcccgcacctatggaaaaagtcaagataaccgtggtctacgacgagggggccctgcccaacaccaaccttatcggagccatcgggatgtccatcctcgtcgaagcggacggcaggcgtacgctattcggtcttggtcacaggccgcgttatcttgagcacaacctgtcctcgttggatatagagccagacagcatagatcagatagtggtgtcccacaggcacattgaccacttcggaggtctcgccggtttcctcaaggacagggagaagcccatagacatctacgctcccgccggggcgtggggcggaaagaagaccgtattcggacctacgggcatcttcgagcccgaggagttcaccgggaagacggtcagacacgacataacggactgggtccaattaagcgaccatgtgttcgtgtcccctccgctgacggataacggcagcgaggagagcttccttgtgatctcttcgtcttccggcccgcttctgataagcggatgctgccacccaggtctcgaccatgtcttcgaggccgtcaaggccaagttcggaaggtatccgaccgcattgatcggaggactccatatcctgaagaaacaggacaaactcgcagacctctacgcccaatatctcaaggatgtcgactgcaggagactgtatctcaatcactgcaccggggtcaacgggataaacaggatgagggtgacgctcggtctcaaagggatcaacgacttctatgccggtcagagcatagagttcaatctggtgtgaacttcataaattatatagaagttcattcataggatattgatattaaaaaggaggcaatcttgtgaaagcatatcgtctcagaacggcttcgatattcgtcatcctgaccctgttcatggtcgccatcggatacgtgatcggatggttcttcgggtacggatacctcgggttcgggatcatgcttgtgatctccgtcctgatgagcttcttctcatacttcttctcgaagcagagtgctctcgctgcgaaccgtgtccatttggtcacacgtgaggaggagccgaaactctacaacatcgtggagaaggtcgccaacgaggcgggtctgcccatgccggaggtggggatcagcgaggtatcgatgcctaacgcattcgccaccgggaggaatcccaagaacgccgccgtcgtggccaccagagggatcctcaggatactcagcgacgacgagctggaaggtgtcatcggccacgagatgtcccacgtcaagaacagggacatattggtcatgtccgtcgcatcctgcatggtgtccgtcctgacctacgcggcccgtatgttcttttacgggaccatgttcggtgccggcgaccgcgacagggacaacaatgcggtcatgttggtgatagcggttctgtgtgcgatcctcgcccccatcgccggactcatactccagttggccgtctccaggaaccgcgagtatctggcggacgagaccggtgccaggatcaccggtaaacctctcgacctcgccaacgctctcaggaaattggagagcggatgcatgaacaaccccaacaaccactataacgacacggcccatgccaacatgtggatcagcaatccgtgcagggagggtttcatggtcaggatgttcagcacccatccctcgaccgacgagaggatcagaaggctcgagatactcgccgacgccatgtcgaagggttcggttcccgcctacacccccgacgaggattcgtcctccaccaaactgtcttaccagtaaaaaaattcaaaaagacgggtcggccttgccggccgaccccatattttatcggttttatttgacgggttcccacttggagagttcgttcaccttcgagagggtggagcccctcctgatctcctcacgggtgcgggtctcgtgttcatggacgtcgagggcgcggttggccacctcgacggcctcttccttggggactacgatcagtccgctctcgtcgccgattatccagtcgccggtacggaccctctgtcccccgaccgtgatctccacgccgatccctccgtagcccttcgcttccccggcacacgggacggcgctcctggcgaatgcggggaatccgaggttctgtatgtcgtctatatcccttatcgccccatcgatcactatgcctttgacacccatgttcatggcggagttggaggcgagttctccccataccgcgatgggtcctcctcccacgtcgacgacgatgacgtctcccggtttggccaggtctatggcctccacgggcttcgcccagtcgccgttggcggtctggacggtcagggccctgccgaccatcttggcgttgcgctgtatgtacgggtgcagtccgaatatcacgcctttcttgtggtatgcatcggatatgttgcaggtggataccttggagaacgcttcgaagaggtcgtcctccgtgtacttcttggccaccacgctgtcgatcgcaagacctttcatggccttcttcatattggcggccgcacctctgatgtcgtcggtcttggttatccctcccccgactatgatgtcgtaggcacctgcgtttatgtattccggaacggtgtccgcagtgatgcctccggcgacggccacagggacggataccgctccgacgatctcgcggaggatgtcgacaggggcctcctctcctctcatctgggtatcgatacccatgtggagacagatgtatgcgacgccgagtttctcgacctctttcgccctcctcaccttatctggcacattgatcatgtcgaccattatctcggtaccgtatttccttcctgattctacggcctccgatatcgtggagtcttccgcaagtccgaggacggtgacgatgtccgcccccgccttcgccatgatctccacttcgaacgcccccgtgtccatggtcttggtgtcggccacgatcctgcggccggggaatgtcctcttcatagtgcggacggcctcggtaccctcgctcttgatgaggggggtgccgacctcgatccaatcggctccgccctcgaccgcttccttcgcgatgccgacgctccttttgagctgcatcatgtcgagggctacctgcaaaaccggttccatggcgaagccatatcctttcgcatatttgaatggtcaataaatactgctcagctcgcccgtcaatcatcaatgatcagctcaatgaaacgatcatcatcgcagcgtcacttcaatgggacgtacgataatttaatggtgttgttcggcatcgtcgctccatcatggccctcctaaagaaagcagagaagaaatgcagcgtcctcttcgtggacagcctgaacgacctgtcctcgcagctggcggagtactacacaagaaagttctatcccgggctgtacgacgtctacagcgccggacccaaacacgagatcgtggactgcgacctcctgtccgtcatgtactgcaacggggaggacctcagggaccaggtctccaaggatttcgccgacgaacgcttcctgcccaaggacaaccagttcgacatagtagtctataccgagaagggtgtattcgacagtctggcacataagtctccctggcaggggaggcagatctgcgcccacatggggtgcagggacgagttcaccgccacggacgacgccgaactcgccgaacagctcctggccatggcggaccgtgtcagcgcatgggtcaaggagaacatggacgaccccgataagttgaggtcgttggtatccgcatgattcccgtactcgtctatgacaaggatcagtgcgatccgaagaaatgcacggccaagcgcatggagaagttcggattggccaaggaggtccctctgaacaggatccctcccgggtcggtcgtcctctccccgttcggggagaagaccctcagtccggcggacgtcaagtatgcgcacagagggctggtcgtcctcgacctcacgtggacccacatagacgagatcccccacatccgcggggagaaggcgaggaagctgccgtatctggtggcggcgaatcccatcaactgggggaagccatggagactcaacagtgccgaggccgtcctcgcatcgctcataataatgggtcaggacgagcaggcggagctcttcatgccccgtttcaactgggccccggagttcgtgaccctgaacaaggcgctcctggacgactacaggacggccaaggactcggacgacgtgcagaggatgtccgacgaatatgtggaatccatagtcgggtcggccggggaacggtgatctccctgggcctccccgccatttcatcgcgagcgtatttttttcagtaaggttattttagcagttgaccatgtctcgagagctatgccggacgagcttttggagatgatttggaaagccctcggtgacgaccgcgtatcgacgaacgaggccgccgcgaggctcgaggagtacttcaaatacaggtgtccggacgacctcatcaagaccatgaacaaataccgcaaggaggggcttgtcaaaggcaaggtctccttcgatgacggcggatggatctggtgggcggatgaggagtgccgttcgaaggccgggcaccgaacgattgcagggggacaatgagatgacgaacttccaggacgctgagatcaccgagggatgggaatccatcttcggcagggacgagtatcggcaggcattgagggagattgccgatacatatccagagaagaagagtctgttcgtgaaatacgacgacatggacatgtacaactcggatttcgccacgttcgtcctagaggaaccggaccgttgcatcaagttggccgaggaggtggccaaggaggccatgccccctacttgggacccggtcaacaagatcaacataaggctgatcagactgccccgcgacgccaaggtcgggataaggaacctcagggccaggcacctcaacaagatggtcgccttggagggactagtcaaaaaggtcacccccgtgaagccgaggatgacgctggcacttttcacctgtgcccgctgcggggcccccatctggcagccgcaggacgggatgcttctgcaggagccgctcatgtgccccaatcccaacgggaactgcaacaagacggccaaccgcttcatcctggacgaggagcagtcgatctataccgatacccagaaggtcgagatacaggaaagtcccgaaggtctcaaaggaggggcgcagccccagaggctcagcgggtacatagacgacgacgtggccgggataatcacccccggaaacagggtcacgataaacggtataatccgttccgccgagaagacggaaagggtgaagacgaccgtcttcgaagtgttcgtggacgttgtgtccatagagttcgagcagcacgagtacgacgagatccagatcaccgaggaggacgagaaggcgatcatcgagatgtcgaaggatccggacctgttcgacaacataatcgcctccatatcgcccaccatcaaaggtatgaacgaggagaaggcggccatagccctgcagctgttcggcgggacgcgtaaggtcatggacgacgggtccgtcatcaggggagacatccacatcctgctcatcggagaccccggtgtcgcaaagtcccagatcctgcgttacatgtcctccatggcccccaggggcatctatgcatccgggaagtccgcatccggcgcaggtctcacggccgccgcggtcagggacgagttcacaggggaatgggccctcgaggcgggagccctcgtcttggcggacaagggtctcgcctgtatcgatgagctcgacaagatgtccaccgaggacaggtcgtccctgcacgaggcgatggagtcccagagaatctccgtggctaaagcggggataaccgcctccctccagtgcaggtgttccatgctcgccgccgccaaccccaaactggggaggttcgacctcgagaacagcaccatcgtcagccagatcgacctgcctcccgcattgatgtcccgtttcgacctcatattcgtccgcaccgacaagccggacgagaagagggaccgcgacatcacggaacacatcctgaaagtacacaggcgcggagaggccctccaggtggacgagaccgtcgaactggacggggtggatctcaagatgataaaggagaacacccagtccatcatgccgcgttacgacgtcgagaccctgaggaaatatgtcgcatattccaagcgtataataccggtcatgaagcaggatgcggtggacatgatccagaatgattacatgtccataaggaagtccggcgacgacaccggttccgtgcccataaccgccaggcagctggaggcctatgtgcgtctatcggaggcttccgccaggatgagactcagtcccgtcgtggaggcccaggacgccaagagggccatagacctcatcaggtactatctgaagaagatcgcgggtaccgagagcggagggttcgacatcgattccataacgagcggcatctcgtccaaggaccgcaaggggatcccgaccatagaggccatcatgagactcgagccgggaggcatggaagaggaggagatcgtcacccaggccgcggccaacggcatcagcgagaccgaggtcagacgtcttctgcagaggatgaagggttccggtacgatctatcaggtcccggacggaaacaacaaggtcatatacagacttaccaacaaaggttgagcaaatggcaggaaatttctatttcaaggcccacaggcatcccgaagaggtcatactcgccgtctgcgacgaggagatcctgggtcagacgttctccgaaggagaccttcgcataaccgtgggggagggcttctacggaggggacatcatcgaggaggaggagctcaggacccgtctcggtacgttcaccatcataaatctcgtcgggaacagggtcgtagaccttgccatagccgagggcatagtggacccggacgccgtgatggtgatcggaggggtcaagcacgcacaggcggtgaccctgtgaacggattctgcgtggaatgcgggaaggaggtggacaagacagtccacggcctctgcatggagtgcttcctcagggacaggaccctggtcaccctgcccgaccacgtggaccttctcacatgtaccaattgcgggcagttctattggcacggggactggcagtccatggtggaggagaaggcagccgtcaccgcagcgaaggaggccttgacctgcataaaggagggaaaggtcgtttcggtggacccttccgtgtcatatctggacgattacaacatctcggtcacactcggatgccgtgtgcagatcgaggacatcgtggcggacgccctcgccacgaccatcgtccgtatcaagaacgccgtatgcaagatatgttccagacgtctcgggaactactacgaggccatcctgcagataaggacctccgagaagacgctttccaaggacctgcaggacgaggtcctggcacgtgtggagaaggtcgtggacgacgccatggccacggacgataacgtgttcataaccaagatggagatcgtaccgggaggagtggacgtgtacctgtccctcatcgccctcgggagggcgttggtgaaggaccttggagacatgtactgcgccgagacgaacgagtccgccaaactggtcggtcagacgagggacgggttggacatgtaccgcgtcaactacctcgtccgtcttcccgagttccatatcggggacatagtcatcttcaggaaacgctactatctcctctcccgcgtctctaaccagggcggaaaactggtctccttggacgggttcagggagatgtcggtgaaacgtcaggacatgccggagataaaggtctactgcaaggcggcggatatcggtacggccgacgtcatcaccgtatccgacggcgaggtccaggtcatggacccctccaactactccatggtggacctgcttatacccaagggtgccgagatcggcgagaaggtacgcgtcatcaggatcgaggaggtcctttatttcgtgccgtgaggaggaatcgaaatggtcgtaaaacttccggagaccacggagaaggtggtcgagaatctgttgcgtctggcgaacacgaagatccccgaggacatcgggtgggccttagaggccgccgccgaatgggagaccaataaaacggcatattcccagatcggggcgatattggacaacatcaggaaggccgagcatctggggaagccgatgtgccaggataccgggataccgatattctacgtccgcgggaagttcgactcctccatctccaaggacatagcgcaggcggtcgagaactgtaccaggaacatacccatgaggcccaacaccgtggacccgttcaccaggaagaacaacggcaacaacctgggggacggcatgccgtgcatccattacataccgaccgatgacgacttcacggagatatctgtgatgctgaaaggcgccggttccgagaacatgaccaaactcaggatgctcaatcccgccgacgggatggagggtgtgaagaagttcatcatagactccgtcctcgacgccgggggccgtccgtgccctcccgggattgtcggtgtaggggtgggcggtaccgccgacgagtgtgtcgcaatggccaagagggccctcatggagcctttggaccacgaggatccggatccgttcataaaggatctggaggaggagctgttcgtgaaactgaactccagcggtctcggacccatgggtctcggcggcaacaccaccgtactgggcgtgaaggtacggaaggccgcatgccatacggcaagccttcccgtggccgtcaacatagggtgctgggcgacccgccgcgcaagtgccaggataaccgattccgatgtcacgtactcccagggggcggtcctctgatatcacttacggcccctctctcggagaaaacggtgagagacctgtccctcggcgacgtcgtatatatcaacggaccggtggttacaggcagggacgacgtccacatccgtgccttggaatatctggacgaggggaagccggtccccaactgcctcgagggtgcggtggtgtaccactgcggtccgataatgaggaagatggacagcggccgttactccgtggtggcggccggtccgaccacgagtgccaggatgaactccctcgaaccgcgtttcatcagggagttcgggatccgcgccataatcgggaagggcgggatgtctcaggaggtcgcagaggccatgaaggaggtcggctgcgtctatctcgccgccaccggaggggccgcagtgtccctcgccgagggcctgtccaccgtcaccggttccgaatgggaggatctgggtatgccggagaccatgtggaagttcgagactaacaggctcggaccgctggtcgtggccatggattccaaaggcaacagtctgtacgaacaggtcaggaacggcctgaaaagagaatactgaacccttgtccgtccggtattccgcaggtctttcctgcgggaccggacttcatcaggacctcactctcccttcaggtcctcttcgtctatcttcgtcctgcctacacgatgatacagtatcctggcacatagtgcaagggacaggccgaggatgataccgatgaacatcaggaagtggaccaggtccattcccagataggtggcatgggtcttttcggtcatctcgaatatgctggtggccgtacctttggtcacgacgatgtccttcttctcggactcgaatccgtctgcggacactttaatcgtgtaggcacctatggtcagtcctgagatggtgcatcctccggaaccgtcggtctttccgtgtatggatctcccgtcgtcggcggatatctctatgttagctcctctaacaccctgtccgccgtagttgacgtagacggtgaccgtgcctgtggtggtcgccatggtgaaacagttcagcccgtccgcggtactggatgttatgagacactccctcacattatcctcgctgctggcagaccatgtggttatcgaaagtctgtaagcggtacctgtggcgacggttatggtatctatttcggaagcatatgacgagatcgatctgaggtcgtattccgccaaagagaatccgatgtacatcttggagacgggaattctgtcgaaatcgatcttgaaacgccctgcatcggcggatgatgtcgtgcagacccctaaagggtcccctgtctcgtcgtatatggtgacgaccgcccccttgaggccgatgttcccgctgctgaattcctcgttgacataacctgtgatgcggtaggtcgtagaggcggcatccgtgctgtcgctgtcttcaagtaatgtcatcggaacgcatagtgctaatactgcgatgacggcaacgacggctgagtggcgcatgaggtctcaatcggtcttttcgctattataacttccttctaaggggactccggtaccgaggtactcgaaaatctgccgtatcggcatcttcgttccatgtgatattgtgccagatcccgacattctacggggatgtcaaaggaagtcgcgtccgatagtaatcgacaccaagtcatcaacgcaccgtgtccgtatccgttcccggcctatgtgcggcaagatcgtttctgaaacgatcaacatgacacgtcagggagtccttcgtaggagcggggatcccgacaccccctgctatggatccatatgtgggtcggaggaggccgtcttctcttgtctggaatctctgtcggaatcaccgtatgtgatgcgagccgagcactatcttttatattacctatcagtagggattccgaattaatctttgttcggcggtgagatattggagaagatagacaggaagtattctatggacgaggtcctcgacatgatggagcctcttgtttccaaatggttcagagagaggttcaccgcccttacggaaccgcagtcgatggccatccctgtcatccatgagaggaaaagcgtacttgtctcgtcccctacaggatccggtaagaccctcaccgccttcaccagtatcctcaatcagctgatcaaatactcctccgaggggaccctcgaggaaagggtctattgcatctacatctccccgctcaaggccctggccaacgatgtgaacaggaatctcaacgaacctctgcagcagatgaaggaactcgcagcccgcgaaggcatgcccgtccccgagatctcggtggccgtacgttccggggacaccccgcagaacgagaggcagaagatggtccgccatcccccgcacatcctcatcaccacccccgagtcgatggccctgatcctcgcatcgcctaagttcaaggaggccatcaagaaggtggaatgggtcatcctcgacgagatccacgacatatgcgattccaagaggggggcgttcctgtccctgaccctcgagatgcttaagaactactgcgagaccgatttcacccgcatcggcctctccgccaccatggctcccatcgaggagatcgcgaagtatctcgtaggtttcgacaaagggggagaggcgaggccggtcgccctcatcgagtccagttccaagaaggtcctggatctgaaggtcatatgccctacggacgatatgacgacccttccgaccgatgtcgtcagctccatgatgtacgacaaactgaaggagctggtcgacgaacatgagaccaccatagtgttcaccaacacgcgttcgggtgccgaggcggtcgtctataagctcaaagagaggggtctggagaacgtggaggtccaccacagctccctggggaaggacatccgtctcgacgtcgaatcccgtctcaagaagggggagatcaaatgcgtcgtatcctccacatccctggaactcgggatagacatcggatcggtcgacctggtgtgtcagatcgggtctcccaaatccgtcgccaagggactccagaggatcgggcggagcggccacagcttcggaaaggtagccaaaggccgtctcatagtcttcgatccggacgacctgtccgagtgtgccgtcatgtgccgtgccgcccatcgcagcgacatcgaccgtgtggggatccccgagaactgtctcgacgtattgtcccaggcggtcgtcgggatgtccatcgaccgcagatgggacgtggacgaggcctacgacgtggtgaggtcctcgtactgtttccacaacctcccattcgataaattcgtgaacgtgctcagatacctgggcagcaaggaggaacacgagagcgtctactccaagatctggtatgacgaggagaacagtcagttcgggaagaagaaaggtgccaggatgatctatttcatgaacctggggaccattcccgaggagtccaactaccgtgtcataacatcctacggttcggtcgcaggggaactgtccgagaagttcgtcgagaggctctccccgggagacgtcttcgtcctggggggcaggagtctggagttcgtccgctccaaagggatgaccgcatatgtcaaggaggccaacggcaggaagcccacggtcccctcgtgggcgggggagatgcttccccgttccttcgacctgtccatggacgtggccagattcaggaaggagatgtcccagctcatcgacgaggatcccgcagacaagctagagaggctttccgaggagttcgacatcgacgaggggtccgcccgttccctcatatcgtatttcagcgagcagaaggccgttgcgggcttcatccccgacatcgaccgtctcgccgtggaagagtacatagacccttccggcaaccagaggatcatcttccattatccgttcggcaggagggtgaacgacgccctttccagaggatacgcgtaccgcataaccgctctgacgggtgccaacgtctcggtcaccataacggacgacgacttcatgatcggtaccacccataaggtggacgtcgaccagatcccgctcatgctgagcacccgcgacctggagccgatcctcaggaaggccgtcaaggattcggagatcttcaaactcaggttcagacacaccgccgcccgcagtttcatgatcctcaggaactacatgggcagatcgataagcgtcaacaggcagcagacccgctccacctatcttctggacatgctccgcgacatggacaacgagcccgtcatcgaggagacctacagggagatcctcgaggacgacatggatatcaagaacgcaagggtggtcctggaactcatcgagaacggtaagatgggggtgagggtcatccacttcaacggcaccccgtcgcccttcgcccattccgtcatcctctcgggattctccgacatagtgctgatggaggaccgtaccgcacttctcaaagaactccacaggaaggtcctcgagagggccctcggtgacggtgtccgcgatttcgagttcgatccggaccaggtcacgcagtatttcacccgtaagataggcagggtctcttccaaagaggacatccccaggcttctgaagcgcaccggccctctccaggcgttcagggagagggggaggaacatctatccgtactgcgaccccgacaagaagaccgtggacggttgggtgagggaactgatccacgagggggtcgtaggtaccgtcttcctcgacgagccccatataatggtggcggaggacatccccgtatacgccgcggccaccgtgcgggagcgtacgatgaacgatgccgaccgtaccgtatattcgctcatcggggaggacaccctcctcagcgaagtgaagtcgaaatgcgatctgaccgaggacatgatcttcaggagcgtcaggaagctggagtcgatgtacgtcatcacccggacggatataacggagaacaaccggtggtatttctccagatgcgatccgccttccggagaccgcgccgctgcggtggacgaggtcatgctcagacatctcggcagtttcgcacctaccacggtgcaggaggcggccttcgccctcaacatcccggacgaggagatctccgtctctctggagtctcttgtgggcagcggggaggtttcgaaggggcagttcctcatatcggagaacccccaatacatgctgacgtccgaccgtctccgtctcaggtccggcaagagcaacgtatacgatttcgagacggtggagaactacaggctcaccaaaggggagaagttcgccaccatagaggacttcttcaaattctatgtgacggccggcagcgaattggacgtttacaacagggtggaggggttcagtctcgaagagtggcagaggatgcgggccgacggccggatactccttggaaggttcgcccgcggaagggtccgtttcatgcttgcggaggacgcggcccgctacgcctatttccgggtggattccacgcaaccgtccgacgacgagatcctggagaggatagagggcagcggttccggactcacgatgagggaggtggtggcggccaccggcatggagaaggagaaggtgaaggaggccatgctgcgtctggaccgttccatgaaggtcgtacacgccttctgggagagggaggactggggtacggagaacatttacgccccgtaccacccggacatcccggaagagaaccccgaggacgacatggtgaggcaggcaatcgtggcgttcggtcctgtgcctactgcgtccatgcgctatctcgtgagcgtccccgaggacgacatacgtccttctgcggagagggtcggtgccgtggagatccttgtcggtcccggtcagacccccatgtacataatgcccgacgaaatccccaagctgaattcgccggagatgccttcggagaagatgagagtcctttccctgtacgatcccgatctcggttccaagtgggcggagatatcgtcccgttacggcgataagtgggtatatcccctgatgaagggaagcagggtggtcggcgccatggagatctgggagatgtccgggtgcatagaggtcagatccatggacctcgacggccccgacatgctggaggatgccctcggggccctcgacgacatgatgggctatttcaggatgaagggtaccgacatcatcaggatcagggagatattgaacgtcgacgcgtccgaactcgcacctgagaccgcccaggtcatgacgtcctgcggatacgtgttcgtcaacgggttctatgccaagggatccttcatagacagggtcatgacccagcaggaggctttgagctatgtcctgcgtaagcagagggtggagaagaccgaccgctacgggacgctccaggaccttctcgccgtgaggaagtacatccggaacgagcaggagctcacctgccgcgtgaccgcccgctccagtgtgaagaaatacatggagaggggggagctggtgaagacgacgctcctcccggcgttcgtcgggtatgtggtcccggacaggctcccgctctatcgtgcggccaagcaggcccccgtcaccgatgacatgaggatagtcgagaggatcgtgaaggagcacggtcccatatccaagaaggaggtcctctaccgctcccccctgtcctatgaggggacgacggagacgctctcggagcttatgaagaggtccatgatatgccaggactccgattcgtattacaggtgggtgcccccgtcggatatgtcccccgaggccgcacagaaggagataatgatgggccacttcctcgatctgggtatattctccgcagagatggccgcccagttcatgggtatgaagatggccgccaccaggaagatgctctccgacctggagcaggagggcaaggtggtgaaagggttcctcatcgagggcgactcgacgctttattggatgcctgcggaggacaaggatgcccgcgtaaggctgttcgccgggatgttcatcctgaatacccaggacaatctgagttactatctgagacactacatcaagcagaggtgcgggtcttcggtctctaccgtatggtcgggaacggagatcatcgggcacttcaaaggaaaggtcgctcccggcggtgcgaaggtcgatgatttcgaagggtcggatctggcgaagaaactggtggaggacaaggcccgctcttacggggtggcgctcgtcaaacgcagcgacgacgaatacgatacggactgggacgcctcggagttctacaacaagacgaatcctgggatttgatgggtatgtattcgacatttgtctaattaacactggcaaaaccggtgcacttgattacaaatgatggcgcatagtttattatctacgacaggatacggagcagtatgaagaccccctgtgagatcgtcgtctggtatgtgctcccgacgatcagaagagaaatcgccaaggagatggttgacacctaccacatgaagcaggcggatgtcggacgtatcttcggggtcaccgatgcggccatatcccagtatctgaagaagaagaggggaggcagcaccctcatagaggagagcaggcattatccggaattcctcgaagaggtcaagagaagtgcgaagctcatcgtggaagagaagtccgacatgtccgtggagatgtgcaggatctgtaagttcatcaagaccgtcggtctgttggccgagatctatactgagaccacccatcttcccgccccgtcgtgtgcatggggaaaggacgacgactcctgcatagtcccgcagtaacggtatcagatgaattccgaatgatacaggaactcctgggcatatccagcatattccccgaacaggttcctgccgtatgccgagacggtcttatagttgccctcgaccccgtatttggccttcatgacgttctgaatgcgcacatccacggggaaggcctccatgtggccgtatccgaaaagggccacacagtctgcgaccttcggtcccacaccgtttatcgtcatcaattcctttacaagaccgtcgtacggcaggtccttcatgccttcgatatcgatctctccgttctccgtgcgctgtgccagctctatgaaacggtgctccctgaaccccagtctgcattcgccgatgcactcctccctgtcgaggatctgtttgggtgtcgggaacgctctgcggggtccgaggtcggtgccgaaatggtcgcatacggactctaccatcttggctatgcgctttacgttgacgttcgtcgcaaggacgtatgtcgcaaggcattcccattcgggctgacgaagtatacgcataccgggacagtgggaagacaggccggcaacatagctgtcgcgcctggagatctcttcgactatctcccccaaattgtcctccgaacggaaatatctgaggatctggcacatgtcggatgcaccttcgcagtcgaatccgttggatgtctgtgtcagggtgaccacatcgttgccgatgacgccttgccacgacccgtcttcctgttttttccagcggtgtgcctgcccgcatcccagggtcggatcgagggcgacgtccatttccacgtgcatgatatctccacctcacaatgtatttttattacttacttcacgtccccgtgtcgtcggtggccgttacatcacaggtcgcaacgataaatatccgtaagggtatcgaggggacatgaggcgcagcacacccatcttggcatgttgtatcgcaggcgccataatcgtcgcggcgatactgttgggttatgttttgtaattatgatgtgccagcaacggatgtcatttcgttccggccgcattcttcatggcgatccgtcagacatgcggggacggattccggtgcgaaacgataaaaggcgttttatagtgcgaatcaatcttctgcgtcggtgccactgtggctcagcggtggagcgacggtttcgtaaaccgttggtcgggggttcgattccctccagtggctccagttctaacataatcatcggtcgggacccttccgtatgtgagtggccccatttcggagaaaagtaagggacctcgtactggtgcagggggcgaaccccctgcgatgtgccagatccctcagtcgcagtcgaatttcttctgcagcgggttcggtttgaggacgtcgtcctcctttatcaggtactggttgacgatcttgatggcgcacacgtctccgcacatggaacacccgtcctgtttctcggtgcatcctctggccctgtaggccttggccttgtcggggtccaggcagacgtcgtacatggtatcccagtccagaaccttcctggccttcgccatcctgtcgtccttgtccttgccgatgcccctgctcaggtcggccgcgtgggcagcgatcttggaagctatgacgccctccttcacatcgtcctcgtcgggcagggacagatgttcggccggagtgacgtaacacaggaaatccgcaccgttctgtgcggctatcgcccctccgatggcggatgtgatgtggtcgtatccgggggctatgtcggtgaccaaggggccgaggacatagaacggggcgccgtagcacagctgcttctccatcctcatgttggccgcgatctggtccatggccatatggccgggtccttcgaccatggcctgtacgccggccttgcgggccctcttgaccagatgtcccaggaccatcatctcggagatctgtgcctggtccgatgcatcgttgatgcagccgggcctgaacccgtccccgagggacagtgtgaactcgtacttcctggccaggtcaaggaggacgtcgaaatccttgtagagggggttctcgcggtcgttgtggagtatccatgcggttaggaacgaccctcccctcgacaccacgtccatgagcctgtccgccttcttgatccattggacggtctccttggtgatgccgcagtggaccgtcatgaaatccatgccgtccttcgcatgtttctctatcccggagaatatgtcgtcctcggtcatctcgacgaccgcgttcttcctagcggccgtcagtccggtctcgtatatgggcacggaccccatcatgacggggcagcgcgacaggagtctcttccttatcgagtctatgtcccctccggtgctgaggtccatcacggcgtcggcgccgtatttcacggcgatatccatcttgcggatctccggctctatgtcgggcatgtccctcgaggtcccgatgttggcgttgatcttgacggagagtccttcccctatcgcggccggtatcgggtcatgggcggggttgcagggggccactatgcgtccggatgctattccgtccaagatgaacctctcggtcaccccttcgcgctctgcgatcttcttgatcctgtggttcgtgacgcctctcgcggcctcttccatgatcgtgcacatgtgctatcgcgaccgaatcgccgtttcgtatatcatggttgtcggtcggaccggcagaagacatcctccttattcgcgcgcacgtgcgtgcgcgtttattattaaatattaatataacaacggcttaacccaacccagtttcagaagagcgagagtcggaagaaatgggaaaagaagacgacatgaggaatggagaggtctatgatgagaactccatcaaggccctcaagggtctggaagccgtaagggtcaggcccggtatgtatatcggaagcaccgatacgagaggactccaccatctcgtatacgaagtggtggacaactcgatagacgaggtcatggcgggtttcgccaccaagatcgacgtcacggtgaatcccgacgggtccgtgtccgtggcggacgacggaagaggcatccctacggggatagtgcccgaagagggcaagtccggactcgaggtctgtcttaccgacctccacgccggaggtaagttcgatcagaacgcgtacaaggtgtccggcggtctgcacggtgtcggtgtatccgttgtcaacgcactctccacatggatggtcgccatcgtcaagagggacggcaaggtccacaggcaatcctataagaccgggatccccgacggacccgtcgaggtcatcggcgagaccgacgagacggggaccaccatcaccttccttcccgacccgacgatgttcgagaccgtcgatttcgatttcgataccctgcagaacagattcaggaaccaggcgttcctgaacaccaaggtgacgatcaacttcgaggacaagaggtccgagaagagggacacgtaccattacgacggcggggtgagtgagttcgtcaagttcctcaacaggaccaagacccccatccacgacagccccatctgcatcaacggcgaataccacgagaaggacgccgaaggaagggacagggtcgtcatagtggacatagccatgcagtacaccgacgggtacaacgaatccgtcgattccttcgtgaacacggtctccacccccgacggaggtacccacatgaccgggttcaggacctcccttacaaagtccctcaacgactacgggaaggagaacaacctgctgaaggacataaccctcgaaggaagcgatgcccgtgagggtctcacggccataatcagcatcaagatggccgacccgcagttcgagtcccagacgaaggagaagctcggcagcagcatagcccagacggccgtcacatccataatgggggagaagttcaaggaatacctcgacgagcacccccaggtggcccagaccatcctgaagaaggcccagtcggcgtacgaggggcgcatggccgccaagaaggccagggacgccaccaggaggaagtccctcctcgagagcacgtcgctgcccggaaaactcgcggattgttccgagaaggacccgtccaagtgcgagatcttcatcgtcgagggagagtccgcaggcggttccgccaagatgggaagggaccgtgcgttccaggccatcctcccgataaggggaaagatcctcaacgtggagaagacccgtcaggacaagctcctcgaccacgacgagatcaggaacctcaccatcgccatcggcgggggtatcggcagggatttcgacatatccaagatcaggtaccacaaggtcgtgatcatgaccgatgccgatgtggacggggcgcatatcgccaccctccttctgacgctcttctacaggcagatgaggccgctggtcgaacagggctacgtctacctcgctatgcctcctctgtacagggtcatgaaggggaagacccagaggtactgttacaacgacgccgagcttgcgaaggcggtcgccgagatgggcggtcccgacgcaaaactcaacatcagcaggtacaagggattgggagagatgaacccccagcagctgtgggagaccaccatggaccccgaccagaggtacatgaaacgcatcgagattgccgacgccatgctggcggaccagctgttctccaccctcatgggcgacgatgtggagcccagaagggagttcatcatagagcatgcgaacgaagtgaccaacctggatgtgtgatagcatggaaggagaagaaaggataatcaaacagacagtcgagaaggagatggcgcgctcctacatcgactactccatgtcggtcatagtcagcagggcgcttcccgacgtacgtgacggattgaagcccgtccacaggaagatcatgttcgccatgcacgagctgggcctcaccttcaacaggccgcacaagaagtccgcgaccgtcgtcggagaggtcctcggaaagtaccatccccacggagatttcgctgcatacgaggccatggtccgtatggggcagcccttctccctgaggtatccgctcgtggacggacagggtaacttcggttccgtggacggggaccccccggccgccatgcgttacaccgaggcccgtctgtcgaagatggcgtccgacctcctcttggatctggacaaggataccgtcgacttcatggacaacttcgacggctccctgaaggagcccactgtactcccttcgaagttccccaacctcctcgtgaacggttccgacggtatcgctgtcggtatggccaccaagatgcctccccacaacctcggggaggtgtgcgacgccatagtgttcaccatagacaatccggacgccaccgtcgaacagctcatgcagttcgtccgtgggcccgatttccctaccggaggcatagtgaacggcatatccggcatagtggaggcatacaccaccggaagaggaaggataaaggtaaggtccaagacccacgtcgaggaagggaagaccaaggattccatcataatcgacgagcttccctaccaggtcaacaaggcggaactcgtcaagagcatcgccgatctggtcaagaacaaggccataacgggcataaccgatctcagggacgagtccgacaggcgcggtatgagggtcgtcatcgagctgcacaaggatgcgatccccgacgtcgtcctggagaacctgatgaagaagacccagatggagataacctacggtatcatcaacctcgccctggtgaacaacaagcccaccctcctgggtctcaaggacatcatcatgcactacatcatgcacaggcgcatggtcgtcacccgcagggtgaggttcgagctgggggaggccgagaagaggttccacgtcctggacggtctgataaaggccctgaacatgttggaccagacgatcgccctcatccgtgcatccaaatccggtcaggaggccaacgaaggcctccagaacctgttggggatcgaccagatacaggcccaggccattctcgatatgaggctgcagaaacttaccggcctcgagatcgacaccatcagacaggagtacgataacctcatcgtcaccatggacgacctgaaggacatcctggccaagcccgagagggtagacgccatcatcaaaggcgaactcagccagatgaaggatgcatacggggacgagcgcaggaccgtcataaacaggcaggccatcgacgtcgatgccgaagacctcatcccgagggaggacaccgtctacaccctttctgcggacaattatgtcaagaggatgccgctcaggacctacaggcagcagtcccgcggcggcgtaggtatgaagggaatggagaccaaggaccaggactatgtcaagaacatgttcgtggcctcctcccacgattacctgatgttcgtcaccaataccggaaggatcctctggctcaagggatacaacatcccggaggggagcaggcaggccaagggtaagcccatagtcaacctcctgaacgacctgcaggaaggggagaccataaccacggtcataccgacccccgacttcccggacgacaagtatctcgtattctgcaccaagaacggtgttctgaagaagacccagctgagccagtacggaaatgtcaggtccaaaggtatcaaggccatcaaactggacgatgacgacgaattggtggaggcggccaagaccgacggcaccgacgagatcgtcctcgccaccaacgacggtcaggcctgcaggttcagcgaggcagaggtccgtccgatgggaagggacaccagaggggtcaagggaatgaccctgggtatgcagaaccacgtcgtctccatggccgtggtcaagtccgacgacctgctcctgacggtcaccgagaagggaatgggcaagacctccgtcgtcagagactatacgatccaccaccgcgggtccaagggtgtgaagacgatcaacctcacgaagaagagcggatacgtcgtcagcgtccgtaaggtgaacgacggcgacgagctcatgctggtatccaactccgggaagatcatccgcatccaggtcaactccatccgtcagaccggacgtgccgcccagggcgtcaaggtgatggagctgaaggacgatgaccgtgtcgccgccgtggagcccgtcaatcccgacggcgtggggtccgaagaggacatgccctacggcgaagaggccgaaggaaacggggagaccgaacagtgatgggcgggtaggacgccgtcggacgataccgtccggcggcatcttctccgcatgaccccggtcacggcggccgtcgacaggatatgtcgtcggccgaccgcccggcagtgttttcccctgccgggtttcccgaaaaacggttccagacaggtctcccaggtccacgtggacgcctctccgagacttcattaaaggtaaatctaaaataggaagtcagtttaagggagtgataagccgccgtagctcagttgggagagcgcgtgactgaagatcacgaggtcgctggttcgaacccggctggcggcaccatgcttttaaatcaaaataatcgtactctcagccgtattcccgatttccgtgcatacagccaaacattaatatgtgccagaggttagcggaaaccgatatgtccccggggacatgaagaaggtcgatcgcttggatgaagaaatcttgcaggacaaaatcctcatagacctccacaatacctctttgacattgggtgaggtcatgtcccgcatagagagttacaagcaggacccgctctacaggaattgcgagatattcatggatggagaccgttatgccatcgtcgcacgccccaaggtgaaaaagtgactttcgagaacaaaggccgcagaggaagggtgacgataggcatctataacgcttacgaccccaagacattcagggaaccgcataggcgcatcatcgcccgtgcgggggacctcgccatggcgttcaatatgaatctggcacttttcgggttccccatcccggaggacaagaggacccccaaggagatagcggatttcatagccggtaccacgagtatcggggcccatggcgataatttcgtccaacttgcagatctgggacgttttcagaccttccccttccccgggaaaggattcccgccacagttgggaaaggtcgttctgactacctgtaaacccgattagaagaagatgttgaacacatctcagctggtggagatgatagagggcgggcagagcgtcctcctcatattcggcatcggtccccacggaactccgaaggagatccatgggatatcggaatacgattacgaagtcacaggcggttgctattctctcgagacatgtaccgctctcggttccgtatgcggaaaactcgattgcagactcaatcctgattgaaagaagggttgggaccgtaccggaaaaacgaccggtacggccttggagtttcagtagtggtcgtaaaggatcttttccggtgcgaagtagactccgttaccttcctctacgcgtccgacgacctttgcgttggcgttctctttggcgatggactccgcctcgtcctcgggtgctatgatggcgaatcccatacccatgttgaacgtctggtaggcctcttcggtcccgatgtttccgagctgcctcagtacttcgaatatgggctgcggctttacagggtcgtcgatgacgtatttcagtcccttcgccatcctgaggatgtttctgagtcctcctccggtgatgtctacgagtccgtggacctcgtgggccttcgttatgcccaggacctccttgacatagatctccgtcggggtgaggagctccttcccgatgctcttggtgagtccggagaccgaatcggtcatctttatgttgttggcctcgacgaccttccttgccagagtgagtccgttggagtgtactccggaggatttcagggcgacgatcaggtctcccttctcgcaggtctccccggttatgatctcgtcttttcctaccactcccatgcaggtaccggagaggtccaatccgttgactatctcgggcaggacggcgatctctcccccgactatctccatgtcggagagttcggctcctctgtttagaccctttccgacctccttggtgactttctcgtcgggtctgtcgatggcgatgtagtcaacgaaggatatgggtgcggcgttgacgcagatggtgtcgttgacattcatggctatgcagtctatgccgatggtgtcccagatgccgagctcttccgctatcaggatcttggttccgacgccgtcggtcgccagggtcacatatctgtcgccgaaatcgatcagactggcgaagaggccggacttatgtaccatctgtccgaatccggacctcttgtacttcagctcctcaactagcgattcgatcgaactcgattttttgtcgatgttcacaccggccttggaatacgtccagccttctgccatattatcggccgaatatcgcatcctcatattatttacttgcccgcgcgcgaggcttacattcatatctgtgtacctgattgagcgtcacgtggcagacctgcatgaccgttgggtggccgagcgtcaccgtgaatattattacaagctcgctaagaaggaaggatatcgttccagggcgtcctataagatcatgcagatcgacgaccgtttcaacgtcttccacgacggggattccgtagtggatctgggggcatgtccgggagggtggtcccaggtggccagggagcgcgtcggcgagaccggtaaggtcataggcgtcgacctcaggtatatccatcccatcgacggcgtccagttcatcatcggagacataaccgacgacaacaccatgatcaagctcttggagatggtcggaggcaaggtggatgtggtactgtcggacatggcgcccaatatcgcaggccactattccatggaccatgcccgttcgatagagctgtgcagatatgcggtagatgtctgcgaccgcatcctcaagaagggcggatgtctcgtgatgaaggtcttcatgggggatatgttctacaccttgcagacccagttggagaagaggttcggaaaggtcatagtccactctccgcaggcgtcccgtcccacatcgtccgaggtttacgtcatatccaaaggtttcctcggtacccataacgtcaggcccaagaagctcgataaaggcgatgacggacccaagttcgtggccaagggcggcaacttctgatcagtcccagaagcgtttcgtcttggcgtagttcacttctgccgccattatgtcgcgcaggaggtcgtcctctcccacatgcatcttcatgaggatccttgccgcgacctcgggtccgataccccttccggccaggactatggccgagagtcctccgtaggagttcaccaggttggcgttcttgactatcctcttgtcggtgttcaccgcctgctggtcccggccgggtttcccgaagtccttcatggagtccctttcataacctttcagcagggccaccatgtaccctccgcactgggggcagacgaacttcttcggtgcatcccccacccttacgcgcctttggttcttacagctcagacacgtggcgtagaggacctcgtcgtcgagcctcttcttcatggcggccaggatggcgtggtctgcacgggccggctgcatgagctccttcgagcgggttatcccttccagaccgatgtgcgagacgttctgctcgacgatcctgatcttcttttcggcgatcatcttcaccacaagttcggtgttctgcatatccaagtcttcccagaggaccatgctgaccgcatcgttgaacgcaggggtgtcacggtgcaggtcgaagagcttggagtagtttatgtagcggcggtcggcgcctttctctattatcccgaacttcttcgcgatgttcatgaacctccatttcagatgggaggaattctgtatggtgagacgggagagggcctccaccgtcccgggttttatggataggaacgtatccctgatcaccctgcggtcgatgttccgggggagttccaggattatgcggtatgcatcggtcgaaatccctatgctctccccgatcctggccgttatcagggcggagattatcttggacagcgtctcgttgaccctgctcccgaagcagcagttgatgatggcgaggcggtctccgatctcgatggtgaccgtatcgtcggtggggaccgtccatttctcggtctgttcatccagataatccttggccctcttcaccgcctccgcatctcccggatacttgtcgaaattcctgatgcggcgcagtcttccgacctccatggcgacctcgaacggcaccgggatgtcggaaccctcccaggccgggacgttgcctacggtacgggcctcctcgaccaggagttcgtcctcgcgttgttccaccacacgccatgtccttcctttggcgatgaaaagtgccagatccccttccagggtggctacgaagctctcgtccagggtaccgatgaccgctctggagccgatgtccctgaccaggtatgtcttttcgtcggggatcatcgagatgttctcgtagaagtagttcatccccttcctcgagcgacggaggaccccttcgtagtccagcaacaatttgatggacttcagttgctccacggtgtcgtcgaaatccttgcgggtgaggtccctgaacggatacgatcttttgaccagggtgaaggccttgtccggttctatgccgccggccatggtcatggccacaagctgattggcaaggacagacaggggattcggtcttcctgccgtgtattccattatcttcgcctcgcatcttctggcgaccaccattccttccaagacttcgtcaggtgcggtggccaagatctccgccctgatcttcccgcctatgcgatgtcctgcgcgtccggcacgctgggtcattctggcgacctgtcttgggctgttgtattgtatgacgaggtctgcgcttcctatgtctattccgagctcgagcgacgatgtgcagatgagtcctttcagctcctgtgccttgaatgcgtcctcggtctccatcctattctctttggacagcgatccgtgatggacccctatggggtaggactcgtcccacatgtggtatctcgaggccaaccattcggccgtttccctggtgttgacgaagaataaggtggatgtgacgctgtctatgagctctctggcacgtatcatgacagccagtatgtcggggtcgctctgcagtttatccatcagttcggcgttatcctctttcggtacagggcactcgactttgatgctgaagtccctgaacgagtcatgcttgcagaggatgacctcccttcctatcccggaaagatagtcctgcacctccctcaggtttccgaccgtggccgagagcccgaccctttggaattccccggccaacagagtgagtctttccagggcgacggccagctgggcccctctctcgttcccggccagttcgtggatctcatctatgacgacccatttgaccttcttcagatgttcgcgcaggttctttcccgtgaacataacctgcatggtctccggagtggtgatgaggatctgcggaggggatctggattgtctctgtctttccgcttgaggggtgtctccgtgtctgactccgacggttatgcccagcttggagcccatttcctccatccttctgagcatatccctgttgagggccctcagaggggtgatgtatatgcagcggatgccctgtccgtcgttatttctgaaaatggagtcgaatatgggcagcatggccgattcggtcttcccgataccggtgggtgccaccactaagacgttcttcccggccgatatcttcgggatcgcatccctttgggggtcggtcggttcggtaatgcccttcgccctgagggcatcaactatctcagggcacagggtctcaaaaggcatagatggaaagtccggccgatattatcggccgggtggtttcaagcctggatcctttccttggcgggctcggtcgcagcaggggcctccttgggctcctctgcgggtgcggtgatctgcagaaggatctctccgatgtccatgaccttgatcttggagttgatggccttcgcaccctgggagaggttggtgacgcagaaggggcatgcggtgacgaggatctccgcaccggtcttctcggcgtctcttatcctgtctgcagcgattcttacggcgaagttgttgaactggctcttgtatcctccaccggctccgcagcacctggagttggccctgttcctgtccatctcgacgaactcgattcctttgatggccttcaggatctcacggggttcctcgtagactcccatgtgccttccgaggtggcaggggtcgtggtaggtgaccttgtggttgaagggctggaggaggggcagtttcctggtcttgatcaggttgttgacatactgggtgaagtggtacacgttctgtccgaccttggcatagtaggttccgaagtcggtggatatggtcttgtagcatccggagcaggtcatgaccatgtccttcgcacccattccgtcggccttctcgactatgcgctctgcgcattcgagggagtgggtggtgtctccggtcctcagaagaggggagctgcagcaccactcgtctgcaccgagaatgttcatcttgacgcctgccctgttcaggacgcggactccggtctgggggatctgctgctgcctgaaggatccggtgcatcctgcgaagaagatgacgtcgggctggtcgtatttgggtacctctgcgggccaccagtctcctctgtgtgcctggtctccgccgtacgggttgtggaccttgccgaccttctcgcccattcccttgtgtgcggaaaggggccctacgccgttcttgaccatccaggtccttacggtctcccagagctctacgagggggatgttggcgtggcagacggcttcgcagtttccgcagccggtgcatttgtacatcgcatcgacgaagtaggggttgagggaagctacccttcccagcggtttgtccaagggtccggcgacgtttatctggttgagatagtagattttacccctgggggtgtcggactcccaaggagtctgcctgtgagcctcgcataccgagatgcagtaaccgcactgtacacatgcggtcagatactgctcaatgtgagggagttttaatgcttccatcttgatgcctcttgttaaaagacgacgggtttcgtgtgcagcccgtctatcttatagataagaaagggaagaaggaatcgctttaataagtctttccgtaaagtcgtctccactggactttatattttggccgacattccgtattttcttgctggattgttgtttttatatgccgacgtcccgatttcttccgtcggatcccgcagtctgtacacgaagcgtgtgcacatgtgcccattttcgtttcgaaaaaggcaatccatgtcggaccaaggtgttgaaatccattgtgccagatgtcagaattcttgtgtatttggaaatcgtatccgacatacactatacggactgtgccagactcggattgtaatatatggtgtcaggcgtcatattcagtatctggatatgtgtatgtcgtcatcagcacatgttgtggtgcaaggaagatatccaccccatatgtctgcgtgtaggtgtctgggtatcggggattctggaccaaataccgtatccggtgtgtcgatgggcaggtctatcgcgatgtctcggggatcggcaatatcgtattcaggaaatgtaatccgacaggatgtcgttcagaatatggtgggcccagccggatttgaaccggcggccatcggattatgagtccgacgctctacctagctaagctatgagccctcaggcacattacatcggttctgataaaaaacccttttgttgtgtcggatggtctgatggcttggataaatgcctctcggcaatgcgagttgattggaaaaatggcgccgtcgcacgggatcgaaccgtggaccttgtgattaacagtcacacgctctaccgactgagctacaacggcttagtgagtgccaatgaaagacccatataaaaattttaggtcagctcttggcgattttttcacgcatggcgtctacgcggcttatgatttcgtccaaacgcttggaaagatcggccatgaactcgtcgtatttgtccgaaacggtcgcaccttcctgggtggcgacgatgagtccgtccttctcaaggagtctcagggagtagcggactttgtgtttcggcaggcccgtcaattcggaaaggcggattattccgacaggttggttctctttcgtcaccttgagcatgagtatgtgacgttcgatgagatccatctcagccatagtccccgaaaagatctctgtcatgtccctgagaactcttttgtggtataaaatgacacgtgctagcacgggttacacttgttgtttaagatatgcgggaaccgcggtttttggccgcgggacccgaaagaatctcggtaagggataccgaacagtacggccgtatcagcgaccgtaccacttctggcagccccaccttctgtagttttggtagaatccctggatgaaggacccacagcagtccagtgctttctgctctgctccttcgcccttgtaggtcttgtagcagttcagacactggaagcagagtaccggcggtgctttcctgtcgaatctcattgcgttcgcaatagaggaatcgatttaaataatgttggttcgccgattgccacagatgcaccatgtgccgtcttcttttgacaagacgttatgtacgtatccatctcttttttgaacggagttcgaggtctggccggttttttctggccagttgtgaggtcgaaatgcacatccaactgttattaaacattattgtggttggaggtttcctgaaacgtactttctccagtaccttatatacaaatccttaatcattaaatactctgcaacctacttaacgagtttatgaacagaattaaggtcatcaacgaaccctctgaactggttcccatgctcagggcggtcgacacccccataaaaagggaggtcctcaaggaagtgaccttggaatggaagaccgccgatgagatcgagaagaaattcggtccagagggaagggaagcgaccatcttcttcgagaagatgaaactggtcgagacccgctggctttcaaccaatggaaactaccccgagaaatcctatcacacttactattcttctttcagcatcaatgcgcagtggcctgtctacgagatcagcgatgttctcgcagccgccatgatgcccgaggaggagtacgcagaactcgaggccaagatcctcgaacaggtcggaaccaccgggaagttctccggagatgtggccgagaccctgggtctttcctccacaatgctcaagagtcttgtacgcaggtccgtgaagatggactaccgcggccacaagatcgagcccataaaagaagactgagccatatgtccgacatctggatcatgcgcatcgggcaccgtcccgagagagataagcgcgtaactacccatgtggcactgtcttccagggcgttgggggccaaagggatctatgtagacaccgaagaccccgtcttggaggagaacatcaggagcgtcgccacccgtttcggaggggattattccatacagacgggggtcacatggcagaaggccacgaaggatttcaagggcaagatagtccatctgaccatgtatggccagagggtcgacgaggcccttcctaaaatccccacggacgaggacatcatggtcatagtcggggccgagaaagtcccggccgaggtgtaccagagggcggatttcaacatatccgtcggtaaccagccccattcggagatcgccgcactggctattttcctgtatctctacacgggcgggaaacacctctatgaggaccgtgacggcgagatgaccgtcattcccaacgaaagggggaagaccgttgtcaagaaagacgactgacaggattcccacggacgaggagtgcatcgcacttctttgggatgcagggtgtaagaagagggtggtcatccactgtgctaccgtcagggcagtcgccgaggagatcgccaagggcatcccggaggcggacatggatctggtggtggccggcgcccttcttcacgatatcggccgttcccaggaccattccatcatgcacgcctccataggtgcggggatagtccagaactacgggctccccagctgtctctccgatatagtccggaagcataccggggcaggtctcgacgataccgacgtggtggaactgggtcttcctcccggggattacatgccccgtacgatcgaggagaagatcgtggcacatgcggacaacctcgtcagcgacaaccgtgtagtcacccacgaacactcggtggagaagctgagggcgaaaggggcggagcgcggtgccgaccgtatagaagccctgcacagagaactgtctggaatatacggccgcgacctcgacctgctggtggcggagatcggggaatatccgaagctgaaaggcgtgaaaccgtaattccggcattcaaacactttggttttttgttatacccctccatattttcatagttgttacataggggttatatgcaacatgcaaattctacaataaggtaattaaaatggtaacggaactcaatgagacgactttcaaggacttcataggaaagagcggaatcgtcatcgtagactgctgggccccgtggtgcggcccctgcaggaggatgggccccataatcgacgagttggacaaggacatggccggaaaggtcgccgtgggaaagctgaacaccgacgagaaccaggcgatcgccatgcagtacgacatcaacgccattccgaccctcctcatcttcaaggacggtgtcgcacaggagcctcttgtcggactcaggcccaaggaagacatcatctcctacatagaccgcctgtgaggcagaccgccatggaagcagacgtcgtcatcatcggctccggtcctgcggggttgcaggccgccatacatgcggctaggaagaaggtctccacggtcctcatagggaagttggagaacagctccactttcgagatccctgtggagaactatttcgggacccccggaaaacaatccgggacggagcttctgatgaacggcgtcaggcaggcggtgtcgttcggctgcgaggtcgaagacatgaacgtggtctctgccgagaggaagggggacaggttcatggtgaccgcagagtccggtgtggtcgtagaggccaaggccgtagttttggctaccggcatcacccgcaacactctcggcgtcccgggcgagaaggagttcggaaacggaaagggtgtgagctactgcgcctcctgcgactgcaacttctacaaaggtaaggcggtcgccgtcgtcggaggtcaatccgaggcggccatatccgcggaactcatgacgcgctatgcctcgaaggtctactgggtgttttccaagttggatgcggacatatcccttgtcgagaaggcggtatccgccggggcggaacgcatcgaggtccctgtaaagcagatcaaaggggacgacagggtcaggtccatccttctttccgacgggaacgaggtgccggtggacggcgtgttcatcgaactagggggtaaatcctccgtggaccttgcgatggacctcggtataatgccggagatggacgattccgtcaaggtcgatagagggtgtgccacctccgttccgggcgtgttcgcctgcggtgacataaccggtaggccctggcagatcggcaaggccgtcggagagggagtggtggccggttccgccgcagcggattatgcgaagaaggtgggtcaatgaccgtagaggacctggtatccagcatgctcagggacgagggcgggttccaaaaggccctcaggaatatcctggacgaggagctcaacatgtccctcaacgagttctgtcagatctccggcatatcccagagtaccgtgtacaagatattggaggagcgtcgcgagcccaatcttcgtacggtgaggcagatcgtgcgtgcactgaaacagatatacggaaaaggcaacgagaagttcttggcggtcatagcgtcctccaccttcatggaaggtcttcccaaatccctcgatacctccgccaacggtaccgtcgggatccgcgagtacaccgtctccaccgtagaggatgccatcatcgcctcggtacgtgcggagagggacggcgccttggggataatctgtgcacccatagtggcccatacggtggagaagataacctccatacaggtgtatcccgtattcccgttggacagcgtgatgaagatcctggaacacatcaaggatcgctactgattgaatttttacgattcagaccgtaaaagtttaaatcaatgcttaacttttaacaacatataccgaaggtgtcctatgtttgaactgcaggtggtttccaatacccccatgaccggggtggacgatatcgacgttctcgccgagacgttccttacacagatcgggtatctctcgaaagggtacgaccccagaagtaacggtgcactcaccatcagagacagcatcccctacaggatattcatggactttttcatgaaaaacccctccaaggcatgggccgccgaagagatcgcagtccttctgggaaccaccaagcccaccgtctaccgctacataaacaagctgaaatccatggacattctggaaagtacggacatccagtctgaggacgggcccgtacgcagggggtaccgtataaggtacggcgacatagccaaggcctggagtttctgcgaggccaacgtacagatggccatggataactacaagaagacggtcgagcgcttccagcagctggccaaggaaagggcggagaagagctgaatgggcgacgacgtcgcaagatgcatcatcgaggccatcagggcgggggatgtaaccgaccgcgactccctccagcgcctcaagatgcagctctgctccaagtacggtccggacaaagtgccccccaactccgaggtgctggcacttgtcccggaggacgaacgtaaggctttcctcccactcctcgtgaagaagcccatgaggacggccagcggagtggccgtcgtggcggtcatgacctccccgtatccatgtccccacggaaagtgcgcatactgtcccggaggagtatccaacaattcgccccaatcatatacgggaaaggaaccggcggccaggagggcggccatgaaccgcttcgacccatatgaccaggtcagcagccgcctggcacaattggaggagatagggcacgacaccgacaagatcgatctgataatcatgggcgggacgttcacgtccagggatccgcagtatcaggagtggtttgtgaaaaggtgcttcgaagcgatgaacgggcacccctcccccagtctggaggccgcacaggaagagaattcccatgcggacaggagatgcatagggctcaccgtcgagacccgtcccgactacttctgtaaggacatacagatcgagaggatgatgaggctcggggctacccgtgtggaactcggggtccagatattggacgacgacgtgttggacaaggtgaagcgcggccacggggtatccgaggtcgtcaaggcgacggaatgctgccgcaaccacggcctgaagatctgctatcatctgatgccgggtcttcccggctcgtctccggagaacgattacaggtgtttcaagaggatgttcgacgacccggatttccgtcccgacatgctgaaattctatccgactctcgtcgtaggtgacacggagctccatcggatgtgggaggcaggggagtataggccattggacacggatgcggcagtgaaactcctgtcaaagatgaaggcatatgtgccagactatgtaaggatacagcgcatacagcgcgacatcccggtcccggagatcacggcgggtatcttgaagagcaacctccgccagctggtgcaggccgatatgaagagaaagggtctgagatgcagatgtatccgctgccgtgaggtcgggcacacaggggaggtcctagacgatccatccgaggtcaggctgggggtcgaagagtacgaggccaacggagggaaggagaggttcatatcctacacgtatcgcgattccctggtgggctacgtccgtctcaggaccgacgattccgatctcgccaccgtgagggaactgaaggttttcggtaacgagaccgccataggtgctgcggccgagagctggcagcacaggggcttcgggaaggccctcctggacgaggcggaacggatagccagatccgaaaataagaagcgcatacgcgtgaccagcggagtgggtgtcagggaatactacgcctcccgcggttatgtcctcgacgccccttatatggccaaggatctttgacgttcagctgtagaactgcgtattgctccagcggtcgcggttgttgcgggccttcgatgccatctccgtgtatgccttgtatgtcatgtcgtcgacggacggtctgacgatctccatggccttctcgaagtgtctgaggcatacggactcgatggcgtggtcctcgcggtaggcgttcagtccggcctctctgcagagggagaacaggtcggcccctacatatccgtctgtgacttcggcgatatgtgccagatccacatcttttccaaggggcatcttcttagtatggactttgagtatgccgagtctggcctccgtatccggtttgccgaccagtatcatcctgtctatgcgtccgggcctcaggacggccgggtcgaccatgtcgggcctgttggtggcggccaccaccaggacgttgttcagctgctccaccccgtcgagggccgtaaggagctgtgccaccatgttgtcggccgcacgggacgactcctccccgttccttctgggggcgagggaatcgagctcgtcgaagaatatgaccgagggagccatctgtctggcacgtttgaataccttcctgaggttctcctcgctctgtcccacatacttgttcatcagttcgggtccgttcaccagaatgaagttggatcccgattcgttggcgacggccttggcgatgagggtcttccccgttcccggaggtccgtagaggaggaccccctttcccgccgagatacccagacgttcgaagtccttcttctcctccccgggaaggaggacctccctgagttcgttccttattccgtccaggccgcctatgtcgtcccatgtgatcttggggatctccacggatacctccctcatgccgctcggctccacctcgctgaaggcacgaaggaaatcgtccatgtccaccctcatcttctccagaagctcggtcgggacgggtttctccagatcgaaccggtccatgtggcgtgccaggcatttcatcgcggcctccctgcacagtgccgcgaggtcggcccctacgaatccgtgggtcatacgggcgatggcatcgatgtccacgtcctcgtccaggggcatggtgcgggtgtggacgtcgaggatcgatttcctgccgtccctgttggggatgcctatctcgatctccctgtcgaagcgtcccggccttctgagcgccggatctatcgaatcctcctggttggtggctccgatcacgatcacgtttccgcgtccgcccatcccgtccatgagggtgaggagctgtgccacgacgcgcctttccacctccccttctatgttgttgcggttcggggcgatggagtctatctcgtcgatgaatattatgctgggactgctcttctccgcctgtgcgaagacgctgcggagcctctcctccgattcaccgtagaacttccccatgatctccggtcctctgatcgtcaggaagctggccccggattcgttggcgagggcctcggcgatgagggtcttccccgttcccggaggtccgtagaggaggacccccttcggggccgatatgcccatgcggtcgaacagctccggatgtttcagaggaagctcgatcatgtccctgatcctcctcagttcctcgtcgagacctcctatgtcgtcgtacgtggttatcttgttgtcgcggccgaaaccaggctcttccgcagacccctggctctttccttttcccggagaatccaggacccttatctccgtcatgtccgagattatgacggcccctgccggcgagcagccctgcaccttgaaaaccgagcggttccccatgagggatacgttgggcaccgttatgtccagaccgggacatacggcacggccgatcagattgttcttgaagacgtcgatgaacttgtcgtctatagatatgcggcttcccgggggtatgttgggggacagtgtgaccttgagggccctcggagggtctatcctcctcacgacgacgttgtctccgatggacaccccggcgctggtcctggtgagtccgtctatcctgactatacctttgtcggagtcctccgggtcgcttctgaagacctttgcgacgacggtcttcttccccttgatctcgattatgctccctatcgtcagccccagctcggcatatgccaccgggtcaaggcgggctcttccgtatccggcctctttcaggcgggtcggtgtttcgaccttcagggttagggagtctgacatcggccgtgtggagtgaatacgcatatatcagagtgtgtcttatacggaggtgcgtcttgtaccggattcacggatggatcgggtctatgtgtctaacgtccccggtttttcaaacgaacttattaaatataagtatggaatcctgcgacaggtagataggatatcaagggcctgtagctcagctaggtagagcatctgacttttaatcaggtggtcgggggttcgaatccctccaggcccgctgagattcttcatgagcgatcgacggcggatcaagtatggggagtaatttgaacatcacacagttttggaaacatctttcccgctgaccggaagcggggctttaggtaggtgaaaatttggcagcagcagacactaactcgttcaacattctcaagcacaaccttgtgccggagcaccaccttctcaacgaagaggaggcgaacgaggtcctcactaaactggggatcactcgcgaccaacttcccaagatcaagacctcggacgcggtcatccaggtgctggagagcatccacggacccgtcgcggagggaagcgttattaaaatcatcagaaagagcgagaccgcgcaggagttcacggtctacaggctcgtaaccagagggtgagcgaattgagggatctagtcaatctttatttcagggacaaggacattgtaaaccaccatatcgcctcctttgacgacttcctcgccactccggacaatccgaacagcaggatgcagaggatcgtggacgacatcagggtgcccaccgacgatgcgacccgcggcatcataaagctggacccggagcgcaccaacggaagggacatcgagatcgtcatcggaaggaggaggctggaggacgggagcatcgacccccagtccaagcccaccatcaggatcgaggagcccaaggtcatcgaggcgaacggatactgccacgacatcacccctatggaggccaggctcaggaacctcaactacatgtcccccgtgtacgtccgcttcgaggtctacgaggacggagtggagaaggacgtcgagaacggcggctgggtccacgtcggagaccttccgatgatggtcaaatccaaaggatgcaacctttacaggtccaacatagaggcccgtctcgagcgcaagatcagcgacgacgagtacgcacaggagatcatcaagcagaaggaggaccccagggagcccggaggatacttcatcatcggcggtaccgagagggtcctcatcaccctcgaggacctcgcacccaacagggtcatggtcgagtacaacgagaggtacggcgctgcggtcgagaccgccaaggtgttctcccagagggaaggataccgcgcactgacccaggtggagaaaaagaaagacgggaccctcatggtgtccgtccccgtcgtctccggagagatccccctcatcgcccttatgaaggccctcggtatggagaaggattccgacatctacgagaccatagtctccgacgacggaatggccaacatcgtctacgccaacatcgaaggctccttcgacatcaactccaagaccggtctgcccgtgtcccagtccccgccttcgtcttccgacaaggtcctgcccggataccacaccaccgaggatgcgctgctgtacctcgagaggaatttcgccgctggacaggccaaggagtacaggatcaagaaggtcgagtccatcctcgaccgttccctgcttccgcacctcggagacaccaaagaggaccgcatgaagaaagcgatctatctgggacgtatcgccaagtccgtcctcgaactctccctcgggaagaggaaggaggacgacaaggaccactatgccaacaagaggctcaagctctccggggacctcatggaggacctcttcaggaccagcttctcctctctcatgaaggatctgaaataccagctcgagaggaacatgggcaggaagaagaacgactatagcgtcgcctcgtccatcaggcccgacctgttcacccacaagctcctgcacgccctcgccaccggaaactgggtcggtggccgcgccggagtgtcccagcttctcgacaggacgtccaacatgtccgccatgtcgcacctcaggaggataacctcctcccttaccaggtcccagccccacttcgaggcccgtgaccttcaccccacccagtggggaaggctctgcccctccgagacccccgagggacagaactgcggtctggtgaagaacgccgccctcatcatcgacgtctccgaggctttccccgagaacgaggtgataaggatgctcagggagttcggtctcgcctccgtcaaagaggaggacacccgtgtattcgtgaacgggaacctggtaggtacctactcggaccccgaaaagctcgtcagcgagatcagggagcgcaggaggtacggcctcatcaactccagcatcaacatccgctacgacgacgagatgggcgaggtcatcatcaactgcgacgacggaaggctcagaaggcccctgctcgtcctgaaggacggaaggaccatcatcaccaggaagcacatcgagggcatccgcgagggcaaggtcacatgggacgacctgttccgcgatggtatcctcgagtggctcgatgccgaggaagaggaggactccctcgtcctcgtccgcccctacaacacccccaagagatgcccctgctgcggacacgcactgtccgagaccgacgtcgactggatgaaccccggcaaggcggagaagttctgcgagctctcctgcaagtggtgccacgacaagttcaacgtccccagcaacatcatcggcgaggacggcaagtccgagtacacccatatggaggtcgacccgatgatcatcctcggagtcgccgcaggaatcgtcccctaccccgagcacaactccgcacctcgtatcaccatgggtgcaggtatggcaaaacaggctctgggtatatccaccgccaactacaggatcaggcccgacacccgcggacacgtcatgcactacccgcaggtgccgatggtacagacccagaccatggactacatgggatacaagtacaggcctgccggacagaacttctgcatcgccgtcctctcctatcacggatacaacatcgaggatgcgatcgtcatgaacaagagctcggtgcagagaggactcggaaggtccaccttcatgaggtcctaccgtgccgaggagcgccgctaccccggaggacaggaggaccacttcgagatcccctcgcccgacatcgtcggtgcccgcgccgacgaggcataccagtcgctcggagaggacggtctgatctcccccgagtcctacgtgcagggatccgacgtcctgatcggaaagacgtccccgcccaggttcctcgaggaggagaccgacttcctgaccccgcagaagaggagggagacctccgtcaccgtgaggcccggagaaaagggattcgtcgactccgtcatcgtgaccgagtccgagaacggttccagactcgtccgcgtcaaggtcagggacgagaggatccccgagctcggagacaagttctgttccaggttcggacagaagggagtcgtcggaaggctcgtcgaccagtgcgacatgcctttcacctccgacggtgtcacccccgacctcgtcgtcaacccccacggtataccttcccgtatgaccgtcgggcacgtgctcgagatgatcgcaggtaaggtcggttccatggagggacgcaccatcgacggtaccgcgttctccggtgagaacgaggagtccatcagggacggtctcgtcaggaacggattcaacaggtccggtaaagagatcatgtacgacggaaggaccggccgcatgatccagaccgaggtctacaccggtgtcatcttctacgagaagctgcaccacatggtcagcggaaagctccacgtcaggtccagagggcctgttcagatcctcaccaggcagcctaccgagggacgttccagacagggaggtctcaggttcggagagatggagcgtgactgtcttatcggtcacggggccgccatggtcatcaaggaccgtctgttggacgaatccgacggaacacagcagtatgtgtgcggcaaccccgcatgcggacacatcgccataatggacaggcgcggacagctctactgccccgtctgcggaaacaactcgagtgtatacctcatacagacatcctatgcgttcaagctcctcatggacgagctcctgtcgctgggtgtggctatgagacttcagctggaggacctctcatgatcaacagtattaccaagaggataggatcgatcaagttctcctgcgtctcgcccgacgagatcaggaggatgtccgcggtgaagatcatcaccgccgacacctacgatgacgaaggatacccgatctcccagggtctcatggatccccacatgggtgtcatcgagcccgggctccgctgcaagacctgcggatgcaaggtagacgagtgccccggacacttcggacacatagacctcgccatgccggtcatacacgtcgggttcatcaaggacataaagctcatgctcgagtccacctgccgctcctgcggaaggctcatgctccccgccgaggagatccagaccaggctcaacaggatgaacaccatcctcgacctcggaggagacacgatcgaccagaagctttacagcaaggagaccgccaaggacgcatcgtccaaaggtgtctgcccctactgcggcgcagagcagatcaagatcaaactggacaagcccaccaccttcagggaggtcaacgacaaccacaagctgaccgccaaagaggtccgcgagaggctcgagaggattcccgacgacgacctcagggcgctcggtatcgaccctgcgacctgcaggcccgagtggatggtgctcaccgcccttgccgtaccccccgtgaccgtcaggccctccatcaccctggattccggagacaggtccgaggacgacctcacccacaagctggtcgacgtcctcaggatcaaccagaggctcagggagaaccgtgacgccggtgcaccccagctgatcgtcgaggacctgtgggagcttctgcagtaccacgtcaccacctatttcgacaaccagacgtccggtatcccgcccgcgaggcacaggtccggccgtccgctgaagaccttggcccagaggctgaagggtaaggagggacgtttcaggtccaacctgtccggaaagcgtgtcaacttctcggcgcgtaccgtcatctcccccgaccccaacctgtccatcaacgaagtcggagtgcccaccatcgccgccagggaactcaccgtccccgtgcacgtcaacgagcacaacatcgagctgatgagggaactcgtcaggcgcggacccgcacccgatgataccgacggatacaaacccggagcaaactacgtcataaggtccgacggaaggaggatcagggtcaccgaccacaacgctcccgaggtcgccgagggactggagatcgactataccgtcgaaaggcagctcgtggacggcgacgtcgtcctgttcaacaggcagccttccctgcacaggatgtccataatggcccaccgtgtcagggtcatgcccggacgtaccttcaggttcaacctgtgcgtctgcgccccctacaacgccgacttcgacggtgacgagatgaacctccacgtcctgcagtccgacgaggcccgtgccgaggcacgtatcctcatgcaggtgcaggagaacatcctctccccgaggtacggaggacccatcatcggagccatccacgaccatatctccggagcatacttcctcacccacggaaaggacggaggaccccacttcgaccgctacgaggccatgaacatcctcctgaagctgccggacgtccaagctcccgagcccgccggagtggacgagaacggcaagccctactggaccggtaagcagctgttctccctgctcctgcctccggacttcaacatcacctacaaggcgtccgtctgccagtgtcagggagcctgcaagaaggaggaatgtccctgggacggatatgtgaagatccgcaacggaaagctcctcatgggtaccatcgacgagaaaggtatcgggaacagcaaaggaaagatcctcgagcgcatcgcccgcgactacggagcggaccgcgccgcgaagttcctcaacgaggtgaccaggctcgctctcggcgccatcatgaaccacggattctccaccggtatcggtgacgaggacatccccctgcaggccgtagagcagatcaacaccaacagccaggagtgcatccagaaggtggacgacctcgtcaactcctaccgcgagggtactctggccgagatgcccggaaggtccctcagggataccctggaggtcaacatcatgagcaccctcgcaggtgcccgtgaccaggcaggtaacatcgcaggaaactacctcggtatgtccaaccccgccgtcatcatggcgaagaccggagcccgtggttccatgctcaacctgtcccagatggccggttgcgtcggacagcaggccgttcgtggtgagaggatcgcaaggggttactgggacaggacgctgccccacttccacaagggagacctcggtgcgtacgccagaggattctgctccgattcctacaagagcggattgaaccccaccgagttcttcttccatgcaatgggaggaagagagggactggtcgataccgcggtcaggacttcgaggtccggatacatgcagaggcgtctgatctccgcattggaggacctcaagctgacctccgacggaaccgtcaggaacaccgtcggaacgatcgtccagttcaggtacggagaggacggtatcgacccgtcccgcgccgtccgcggaaaggccatcgacctcaacgacctgctggcggaagtcctcggcgacgacgccgacaagctgctcaacgtcgaccagaaggagaacagcggagacgactacggtgcccgtgagaaggacctcgagagtctcggcgacgacgacttcgactccgacggagacgaggagagcaccgattacgacgacggcggagacgacgactacggaggtgagtgataatggctaagaaagataccataaacgcactgatgaaaagggacgtcagcgaggaggtcgccaacctcatcatgtcgaagtacgtcacgctcggcgccatcgccgacgccggtgtcgacggcctcgtggccctcggcatcgagcagtcggaggccgagtccatcatcgagaagatcggcaaacgcagcgtatcccacagtacctccaggtccaaaaaggacgaggcctccatgcccgagttacctagggtgcctcccgaggaggtcttccgcccccacgagtacaccgagatggagaagaaactctacgccatcgaggagaagctcggcgtggaccttcccatgaagatcgtctgcgacatcgcccacaggatcgagaacgcggatctggacgacgagacctgcgagaagctgatctccgtcgccaacaggatgtacacctcccacctgatggaccagaacgagtccgcaggtgtcatggccgcacactccctcggagagcccgctacccagatgaacctgcgtactttccacttcgcgggagtcgcgaacatcaacgttacggaaggtctgcccaggataatcgagattgtggatgccaggcgcgagcccagcaccccgtccatgaacatcccgctcatcggtctcgccgccgaggacgagaagttcgccaggtacgtggcgtccaacatcgagatcacctccctgctggatgtcgcatctatcgagaccgacattaccaaccagaggctgatcgtcactccggatcccaagaagatggaggaccgcggactgcagatcgacgacatcaccgagaggcttaacaagatcaaggccgtccgcggcatggtcaccaaagctgattacgacatcatcatcgcatccgaggagccttccttcaagaagctccagcagatgtacgatgccgtaaagcacgcaaagctgaaaggtatcgacgggatcaagagggcaatcctcgagaaggacaaggtcaccggacactggtcgatcgtcaccgagggcagcaacctgaaggaggtcctccaggtggagaacgtcgatgccgtcaacgtcatgaccaactccgtattggaggtggcggacgtcctcggtatagaagccgccaggaactccatcatccatgaggcgatgaccaccatgaggcacgccggattggatgtggatgtaaggcacgtcatgcttgtcgcagacctcatgaccaacgacggtaccgtcagggccatcggaaggcatggagtctccggaaagaaatcgtcggtgctcgccagggcagcgttcgagatcaccgccgcccatctgctgcacgcagcgatggtcggagaggtcgaccacctggaaggagttaccgaaaacatcatagtgggtcagccggtgaccctaggaaccggcgcagtcaatctcatatatacacccaagaagaaaaagggggaagatgaatgagcgaagaagtagatattagcaaagcactgaaagcagccatcgccaccggaaaggtggagttcggagtcgaccagaccgagaaggccgtcaaggccggaaaggcacagatgatcgtcctcgcagacaactgtcccagcgagttcctcgtctcaaacaacaaggtcaaggtacacgtctacggtggaaacaacatggagctgggagccctctgcggaaagcccttctccgtatccgccctggccgttatcgacaagggtacttccaacatcttaacgctgtgagtgctatggcagcggatatcgtactgacagaggacaccctacgctatatcgccctgttccagcagttgacccacaccaatgcggtcgactgcatggacaccgaggacaagctcgtgtttgtcgtcgagaagggtcagggtaacatagcggtcggaaagaagggggagcacgtcataaagctcaaggacatgaccgggaagaacatccaggtggtcgagtactcggacgatccccagcagttcgtcatgaacgtgttccacatatacaatcctcagaaggtcgttatcgagcagcgcgggaacataacgcacgccaccgtgacggtggaccccaaactcaagggtcgtgcgatcggcaaagccggaaagaatctgcgcatagccagggatatcgtgaacagacatcacgacatccagagcctcagtgtggattgaccggcgcccccggttaacatctcaaggtgtatggaacatcagaaacttcttacctgaccctcccctcgcgggagggtcttgtgattttggttctcagttgagcggggtcctctcgacttccagtctgtctttggtaggatattcctccacgatatagcatttgaacggaagctcctccgctatctcgtccaggacccatgatgcggtctctatcctgttcctctccgcgtccaccagtatgaggtcgtctggcacatcgtagttgtccttcagatatctggccgctccgtcgaggtcgtcggagtatacgatccccttgagtatggtcccatcctctgtgaccacgtcgtattcgcgggcaatgttctccgcacgtctcttgagccggttcctcagctggacgccgtctttgaatgtggaggagcagaaatgcaacggtgcgtcaggaagggcattcatcacctttatggccgtctcctccgagcccagtacggcggccgagaggtcgtccttgatctcataaccatgcgcttccatcatgtcccagttggtctcggagaactccagttcgttgaggttgatgaatttcactccgacgcctgtcgcgtatccggcgagttccgtgagctcgccctccttccccggaagtgctggaacttctatacccacatccatgccgacactcttgacgatgtcctccagttccgtcgtatccatgcaggtccagaggtcctcgcggggatggtagcggatctcgtcgagtcccgcctcctccaggagctttgcgttctccagacttatgacggacgtatacatgtggatgtggtggtcctttccgaagtgatccttcaggagacggatgtagtgcagggtcctgtccagattctcggaggggtcccctccggtgatcccggtcccttccgcgtccatcgcctcggcctcctcaatgatctggtcgtcgttcatggccgggcattcgttcgcatagactgtgtcccttcctttcctttcggccgatatcgggcagtagaagcatcccgctttgcaacggccggtgacgaaaaggaccatcttggaccctcttatgcagaattcgcaaccgtttgcaagttttccgttggcggcggaccccgaatcgaacctgatgaaggacatgtcgcaacatctgtagcaaggttttaaaaatattcggacgatggcaaccgcgatgagaaagagcagccgtctgatacttgcgctcgacgagaccgacagagagaaggcactggatatcgccgatgccgtgtctggcactgtggatgccatcaagatcaactggccgctcgtcctgtccgccggtccggagatgataacggaactttccagacgctccgacgtgatatgcgatttcaaggtggcggacatacccaacacggtccatctcatcgtcgacggcgccctcggaagaggggcttcggcggtcatagtccattctttcacggggagcgattccatgaaggaggcggtcgataccgcggcgggaaggggcaacatctatgccgtcaccgagatgagccatccgggcggaaaggagttcacggcacctaacgcagaggcgctggcacttgtcggagtaaggtgcggggtgaagggattcatcgcccctgcgactcgtccggacaggatagccgccatacggaaggtcataggggacagggagatcctctcccccggggtaggtgcccaaggggggtccgcctccgccgcgataagcgccggtgcggattatgtcatagtgggcagggccatttataaatcggacgacccgtcgaaggtggccggggacatcgccgacgagatcaggacggtactctgaaagagccagcgtcctgttcttccatccaactccttccccaatatattatattaataatacgcgcccgtaaacctataaataacaaatcaggcatgtttgcgcattcgatatcgttacggagaatcgagaatgcgcaaatttgctatcggaaaagccgccccggatgatggggaacccaagtcttccgcgaacagcgggagcaagggcgtatggttcagagagcattggcgcttgctttccatgttcgcgatcatcatcgcagccttcctcatgaggttcgtattcgcgtacgggatctccgccggagacaactatgcgttgtccggcggttcaagcgcttccaacaacctccgcatagtggaggagatccttgcgggtacctacagtcccgtcagggatgcggcattgaactaccccttcggatcggcgaacacgttcggtccgcttttcgactatattatcgccgccatcgcgttcgtcgtgaccctcttcggggtctctgacgctaccgcggccgccggagtcctcgcatggtccgcccccatactcggagcgctcacctgcatccccgtctacatggccgccaagaagatgttcaagggagacgagaccatcggtatcgtcgcagccttgttctacgccttcttcgcgctgctcatcatgacgaccccgttctccaacgggacgggcttcgcgttcatctgcttcgtcgcagcctggatggtctacttcctggcatcggcattcgaagcggtggacagggattccgtcgccggtcccaagggcgtcttccacaacaagtccgccctcatgtacaccgtcctcgcagggatattcttcgcagcggtcgtactttcctggaccgatttcaggatgtatgtcgtcgtcgcggcggtctgtctcgcgatagcgatgatcgtccagcgtatcggcggaagggacatgtggtccgccgtcctcatagtcgacacggtcctcgccatcggactcgtcctcggagcatgttattacatccccgtcggactgtgggacgccgtgttctctggtggattcgtcctcggtctcctgaccatcgcgttcagcatcgccttcgcggccgtcgagaagaagccgtgggtcgtcacgatccccgtattcatcgtcgccatcgcggtcgtcgccatcgccttcgccctcggactgcccgagatatccaacgcgatgacccacgggaacagcgtgtacaacgggagcctcatgcagtccctcgtcaacagcgcatcccgcacaagcatctccggcatggcctcttattacggatggctcaccctctggttcccgctgatctacggcggatggatgctttacagatacaggaagcactccaactccaggatgtacgggttcaccatgctgttcctcctctccatgttctttgtgggatggttcaatgcggactatgccgtattggcaggtgccgcattcgccatcggatgctccgcactgtccgtgaggatcatcaggtccgtggacatgaaaggatacttcgcatccctcaggggcaacggtgtcaaggccggtgccaggaaggcactcaagttcttcccgttctccacccttctggtggccgttcttctggtggtattgcccaacgcggtatacgccgtcgacgccgccacccccaccaacgacgagaagtccggatactacggagggctcggctacacgatcaacaccgccgaggactccatgatcgactcgctctggaacgagtattccgatgtggacaagagcggttccctcgtaacttggataggtaacgccaacgattccgtcataaagggcggattcaagagcgtcaccgatgccgtgggcggaggggcctctgcgatgacgtccgtctatctgtccgatagcagtgcgaaggtcgtcgccacgttcgccctccgtataatgctctcggcggacctcgagaacttcagggcggacatcgcggccgccggtctcgactacgccgagatggagaggctgaccaccggaagcggtgcgaaggattacatcgcggccaattccgacgacttctccggaatcgacatccccgccctgacggacgagaacgcggtgtacctggccgtaaccgattacatcgtgaagaccgtctccgaggacaagatccaggagatgtactcctccgtatgtgtctctgccaagcactacaacggaatcaaatacgtagaagtggacggaagcatgctgcccatctactacaacgacagctcctcgttctccaccatggcgtacctcggcaactacaccaccggttcctacggagcggtgagcgagttctactcgatcaactcctccaccgggtacacgtcctacaccaatgcaatgtaccagacattcctgtggaaggccctgttcggtatcgacggcagcggttacagcagcagtatgacattcctgcagagcctcgctctcgccgacaagagcgtgaccgtcaccccggcggccaccctcgacggtttcaaggcggtctactggcacgtcatgtacaaccccgattcctcggccacggcatcctccgacggatgggtcgacatggatgcatacgaggcgatcgcgaagcagaagaccgacggcggactcatcaactatctgtcctccgtagtcctgcttgaatacgtcggcaacaacgcctccgcccacaccgacctctcgggtaccgtcatcgacggaaccggtgcggtcaagggtgtgaaggtcgcggtgttcgagtacgattcccagctcgggaagtatgtgcagcgcagcaccgcatacaccgacggcgacggtaaatacacggtggcggtccccaacgggcccgactactatgtgacgttctacgtcggagcgaccaatgcatacgacggtacggccgtggatacgcgcgtcaaggcaagtttcgagtccgacagggatctggcactgaccgctgtggccgtagaagggaccactgttctctcctcggacggttctccttatgataaattcgagggatacctggtctacaccggtgtggcttccggtaaatcatatcaggccgctgtaagcaacggtttgatcagcgaagtccacatggtcccggacatctacaacgccaccctctatcttgcggacggtacttcagtgaccaccgccaaggtgacggtgtcctccgccatcgaaagctccgccatcgaaagccttcgcatatccgtccccaccgggaccgtcaccgtcactgtcaccgacgaatacggtgcgaaggtctccggaaccgatgcaagcgtctacaacgtggataccggagaggtcttcaagggaaccaccgattccgcagggtcggccaagatagtcgtccctgccggcacatacggtgcacaagatgcaggtaacggatatgtcatatcatccacctccaccgtgtccgtgtcgtccggaggatccaagaccatctcccttaccgcatatcctgccaacaacatgaatatcaccaacaacagtacgggatctgcccctacgatctcctcgattggatacacatccattgcgtattccgatacgaaggcatttgtacctgctcccggaggggtcgccaacacctataccgcctatgtcatatccgatggcaagatctactatggagtcggaacatcttccggcaccggtatcgctctcggtgaagggaagaccgtctattccgtgaccggtacggtcaaggacgtcgacggcaaggccgcatccggagtcaccgtgaccttcataaggggtgacgacggcgcagtgttcagctgcaccaccaacggtgacggtcagtataccgcctatgttcctagcggcacctacaccctgtactcctacaacggtgacggtcaggcggatctcaggaccctcgaagtcgccggtgacatatccgccgacagcgaggacgggaacatctccctgcgcatcgcatactccgtcagtcagaccgtcaacttccacaccgggaccagcagttcgtccaccaagaccctgccgttctacggtctgagcggaaagatcaccgatggagagacctcctacaacctgtacgtactcaccaacacttccggaaaggcggtgttctgggtgcccaaggatggaagcatagatgtgaccatgtctgcaatggacgccgttctgctgaaggtcctgaacgacaagaccaactcctctaccggagttacgtccaacacatctctgtccacgatgtcgttcgaactcaccgaggatgcggagaagcctctgcaggtcaagaagatcggagtgaccaactccaccgaatacgacctgaagatctactactacaccgacaaggattccgagactcccacatatttcgagcttcagaagaacaacggaaactcgatccagctgttcgccggcaagtattacctggtcgtcgacgagctcctcaaccagggatactacgcagacgacaacttcacggtctatctcggtcacaacaacctcaccctcgattccctgaccaacgggttcgagtgctatgccgtcgaggtcaagtacaccgatggcgactccctcagcatcaccgctctgaaagattccgacggaaacaccgggacttacgagaaaggtgacaagtctacatcggacaccactgtcactgtgaagtactacctcgagaagaaccacgagtacatcttcagcgtcaagtccggagaagacaaggtcgcagtctctcagaagataacctcctccatatccgctgtggatctgacctctccctacgagacggtgaaggtctccggatacgtaggtgtgacagcggacggaagcatgaccgtggaatacacatacaatgccgtggactacgagctcggagtcgacatcaaggacggaaactacgagttcaacgttccgaagaacgtgacggtcagcatgagtgtgaaggtcaccgtcgagagcaacaatatcaaatacgagctcaagacagatgccgacgagtctgtggcggtcgaggacaaggatgtcacctacaacttctccgtcatcagcaatggcgtgggatctacctacgacgatgccgtagaggtagtcagcggatccttcgacaccgcaggaaacggaactctggagatcaaggtcttcaacaccaacaaatactccatgacctacgtgataaccggaagctccgtgttcgtattggacaaggcctacacgctgacgatcgccggcgagagcaatggaacggtcaccgtgaaaggacatttcgatgccaccaagatcggggccggggactccaacatgtatgtgaccgtttccgacaccgtcggtaacgaggtcgccaagtgcatcgttcctgcgaacaagtatgcagccgcttccactgtgaacgataccgtcgtaaacgtcacatccgccgacaagacgagttccgatatcgccgccggttccgtatacaggtatgcgataaccatcgtcaaccccaactccaacctggagtatgcgaatgtgaccgcatcgctgtccgattcgtccgtcaccggctggaaggtgttcgtcgtcgacagcaccggatacatcatctatgcaggcgacagcaccgagaagttcaatctgaacggattctcgaccaccaccctgtatgtcatggtgatcaacaccgacggcagcagtacggccgttcccaaggtcaaggtcgatgtgaccgttaccgatgtggccggaaatgccgtatcgttgaagaccgacagttcggagatcacggtgagcggcaatatcgcatccgcggccgccctggaggctcagacggccgatctgtctctggacagcggctctgtctccgacggaggtgcttccaatgagggtaagaagatcagcatgaccttctgggccctcttcatactgaccgtgctggtcctgctcctgataatctggacgggatccaagaggggggtgttctcacgcaagtgaaggtatggaccatgctcgcggccgttctggtcgtcttctcggccggggccgttctcctaagcgagaccggttctgagtccgaggccgccgattcggaacagaccgccaactactcgataacaggtgatgagacttctgtaaagcccagcggtgaactgaagttcgacatgacgtttaaggagatctcctcgtataccacgctctcgatatcgtatacggctaagctgaccaattcctccgggacgacccagagcagtgcggtcagcccgtcctccggggacatggataacggagaggtcgtcaccctcacggtgactgcgcccaccaccaccggcaggtacacccttaccgtgacctggacggagtccatcgacggcggcagcgatatgacctacaccgacagtgtagacatcaaggtcgtaacaccgataaccctgtccgccacgatctccaacaacggggaggtagacatcaacacgacggtctatttcttcgtggatggagagaagatcgaggacagcgccaccacgctgaaggtctcacccggaagttccagtactatatcctacaagtactacagttcgaacctgtctcatggtcagcattcgttctatgtcgcgacttccgatggcagcatagtcttggagaagtccacgttctattacgaggacggtaactacgactggctgaactacgtgatggccatcatcttcatcatcgtcatcatcgcgttcatctacgtggtgaggaagccggtgaagaactacggtaagccgaaggccaggcgctgaaaaccattcaatgggggcgaaagccctcttttctttcaatatccacttcagatccgtttccgtcaggtgaaagacgtcctttcggggtcggatgtctcattcaggaagacgatgggcggatatcccgtctattgtaagggggggcgtcatcggagggatctatgacgacagattcctgttcaacatgatccagatgtccgtatcggccctcggtgaagaggttcggggaccctcttacgagggtgcgaagcctatgccgaaggtatgtgacgtggacgatgtggcgttcctcaagggattgttggaaggtattgccgcagatcctatgaaaaagatcatcttcttccgtaacgtgacatcaccatggcagtggacaggtctgtgcgagaacggtccattatgcctctggctatgtcttgttttcttcttatgggcgctaccgaatccttgacatcgaaggacatcagcgcatcggaaaggatctccatcttggagaatgtcttttcggctttttccatgtcatcttccatcagatagcggagcagatccctcctgagttcccctatggtgtccgcaagtcccatgacccaggcggccggtgtcacatcgaggaccaggtatgaagggatatcctgtccgcgggagacgtaatcgtagatcacagtctctgcgaattccatcatggcatcttccacggattgtccgtatacgatctgcggatatctcgagacggactctatgagtgccgcgatgtctcctgaaatggaatcgatcagttcggcgtcccttctgtcttcatgtatcaggtggatggccgtcttcgtctttctgattatttttctggattgcgagaatgcggattcctgcgcctgttccagatccgtaagtgcacgtgtaacatcctctatctgttcttcgaaggtcatcgcctcatctcggggtagttcagcgatctgtggaaatcgagcctcatggcatcgacatacaggtcacggtctatgcgcttggtataagggcacgtctccggtctccagaattccagatctgggtatgtgacatccagcagggtaagtccgcagggtttggcgagaccgaaggtggcgtctttacccgcgaggacctccttgacatcatccagggacgacatgccgtttccgacctgtatgacggcggccattatcctgcggatcatgttccaaaggaagtaattggcacagaagtcggttatgatgacgccgttcccggtacgtacttccacggaatctatcgccatgaccgtggaccttccggtctcgttcttggcgaacctcttgaaatcatggtgcccctcgaatatcttggcggcctcggtgaaacgtgccagatctatattcttcgaaggggtgacatacctgtagtagcgcttatccgccatcctcggattgaaggtgtccgatatctcggccaccccggtatagtagactcccctcgatacggaattgagcgcttggagaagaagacccagatccttgaattcggtgtagaatgcgacgacgttcccgagggcgctgacgcctgaatcggtgcggctggagaaacggaggtctatcctgtcctccggcacatggtccaccaggattagtttgtccaggatctcccctgcgacggtgcggaggcctgtctccgggggttgtatctgggagccgttgaatccgtctcccagataggctatcttgacggctacacgtctcattgtccgcggatctggttcatgtggtcgacccttttctggatcagctccgccgttccgatgtcgtggcggacatacgatgcgtcgcatctgacgtagttgagggctttctcgcagttgtcgttcgcttcggcgaggttctcgccgatacccacaatgcctacggaacgggacgtcccggtcacgagcttaccgtccctcttgtccacgctgccgaagtatgcgaccgctccgacgttatcgatggcgtccacgtcgacggcgatggtgtgtccgggctcggacttcacgccgtatcctctgggtaccaagtatttgcagacggtggccttgggggcgaactcgacctcgcccctcatctttccggtggccatccatctgacgatctcggtgaagtctgatttcagggcggtgaggacgttcatggcctccgggtctccgaacctggcgttgatctcgatgatcttgggtccgtccttggtcagcatgaactgtccgtacatggtgcccttgtaggggcatccctcgtcggccagtgccttgacgatggatcttactatgtccaaggccttctgtctgtcttctgcggtcacgaacgggagaagcccgtccgcatcgctgtacgaccccatccctccggtgttgggtccggtgtccccctcgtacgcacgcttatggtcctgtaccaagggcatggggatgatgtcctttccgtcggtgaagaccatctgggtgaattcctccccgaccgccttctcctcgatgatgaccttcccgccgcctacgttgttctggaagatctcgtcgatgtatgcgatggtgtcctccacatccttcagctggtctccctggaccttgacccctttcccgcctgtgagcccgacgggtttgatcgccacggggtacttcacgttcctgacgtattctatggcgtcggtctcgttgtcgaagctggcgaacgcgatgttcccttcgatgctgtatttctggacgaggttcctcatgaaggtcttggaggtctctatcctggccgccgccttggtgggcgaggcgcatttcacccctacgttggcgagggcgtccacgacgcctgccgccagaggggcctcgggtccgacgaacgcgaactcgatgaagttgttgatggcgaagtcgcagatcttgtcgatgtcggattcgtctgccagaaggaccttcttggcgagttcctctatcccggggttggcgttcttcatcacggcgtatatctccgcgcctccgcgggcgagggcgcacactgccgcgtgttcccttgctcctccaccgattgtcaagatcttcatgttgctcacttgaatcacctatgttccaagggttaataaagcgttttactgcatgcaggaccttcacaggccgagggcggcgatgacctcgtcgatcccgtcccccttcttcgcgctggtggtatacatcttcttgacgccgccagtcagtttcgcgtagtcgtccaggatgatctgcgggtccactccgaccgcatcgcagatgtccatcttgtttagtacggctacatccgagtggaggaatacggcgtgatgtttcctcaccatgtcgtccccctcggtcgtggatatgacgaccgccctgtaatcggtccccagagggaagtccgcagggcatacgaggttcccgacgttctcgattatgacgacgtcgtacctgtccaggtcggtgccttccaggaccttctttatctgccaggcctccagatggcactccttgttggtgttgcagtttatggcttccagtccggcggccttgaacctcttgaagtcgtcgtccccggtgacatccccggcgatgaccacgaccttcttcccctgttcctccagcctctttcccatctcgcagatgagggtggtcttcccggacccgatggatcccatgaagtccacggaccttatcccgtgctccttgaacatatggtagatctcgtgggccaccttgttgttcgctttgaggacatcggtctccattccggcctgaactatgtgcataatgccagtgatatccgtacctcgcattaaaggttagtcatgcgcgtacgtataaaagggacgacggaatacgtcgccacattatgtatgctgaattcctgtcgaagaagctcggggacgcaggtgcagaggaaggctgcacgctgtccatcgagacctccggtaagtcttacaaaggagtcctgatgccgcatcacgagttcagcggcgaggacatagtcatcctgaaggtcaagagcggatacaacatcggtatccgtatcgacgagtccgccgagatcgaagtcgtctccaagcccgtcgagagggtgaagcccgagtccgccgaggagaccaaggagggtctgaagaccatagtcctgataggtaccggagggaccatcgcatcctacgtcgactacaggaccggtgccgtccatcccgccctctccacgtccgacatgatcaacgccgttccggagataaaggaggtcgccaatctgaaggcgaaggtcctcttctccatcttctccgagaacatgaccgtcccccactggcagaaactggccgaggccatcgccgaggagctcgacggcggcgcggacgccgtcatcgtcccccacgggaccgataccatgggatacaccgcatccgccgtatcgttcatgctcggggaggtctccaaacccgtcgtcttcgtgggtgcccagaggtcttccgacaggccctcttcggacgcgagctgcaacctgatggccgcggccaagttctgcgtggagggcggccgtgctggggtattcgtggtcatgcacgacggtcccggggacgactcgttcgccgtacactgcggtacgcgcgtaaggaagatgcacacctcccgcagggatgcgttcaagagcataaacgtcccgcccgtggcacatgtggacaaggacgggaagatagtattcaacacccccggaagggccgtatcggatgcgaaggtggaggccaggagcgccatgtgcacggacgtcgtccttctgcagttctatcccgggatggaccctgccctgttccacgacgtcgtgatgaagagcaagggggtcgtgatcgccggttccggtctcggacatgtcaacagcaacatggtgcccctcatcaaggaggcgacggacgcgggtataatcgtcgtcgtgacatcccagtgcctgaacgggaggacgaacctcaacgtctacaacaccgggagggacatgctcgccgcaggagccataaccgtctgggacatgcttccggagacggcctacaccaagctgatgtgggcgcttgcgaacacgtcctccgtcgaggccgccaaggtggtcatgcagaccccgctggcaggcgagatgagcgacaggagggagcttctatgaccgatgagaaatacgagatgatgtgcggcatcgagatccaccagcagcttgatacccacaagctgttctgcgattgccgcagcgagctgtcggaggacggtaccggcggcatatacaggaggctcaggcccaccacctccgagatgggggaggtcgaccgtgccgcgctggcacagttcaggagaggatacgggtacaggtatcagagctgtccctgcgagacctgtctcgtggaactcgacgaggaacctccccatgaggtcaaccccgatgcgatggagaccaccctgatcttcagcgagcttctgggggccagcgtcatcgacgaggtccagttcatgaggaagatcgtcgtggacggatccaacacgtccggtttccagaggacgtccctcgtggccgtcgacgggtccgtggaggccataggcaggaagatcggcatcctctcggtctgtctggaggaggacgcctgcaggaagatcgagacgagcgataccgaggtcacatggaggacggaccgtctgggtatccccctgatcgaggtcgccaccgctcccgatatgaggactcccgaggaggtcatggaggtcgcctcgaggatcggtaccctcctgagggccacaaagagggtcaagagagggctcggcaccatcagggaggaccttaacatatccattcccgacggggcccgtatcgagatcaaaggtgtccaggagctcaggatgcttcccgacttcgtctccaacgaggtgaagaggcagaagatgctgctcagggtcagggacattctgaaaggcaggggcgtgaagccagtcccgatagaactggtggatgccaccgaggtattcagggactgcgaatccaagatcatctcctccgccatcaagtccaagggcaaggtgctcgccgtcaggcttcccggtttcgccggggtcatgaacggggacaacaagaccctccgtctcggttccgagatggcccaatatgccaggaccgtcggggtcaaggggatcttccattccgacgaacttcccaactacggtatcgagcagaagtatgtcgacgccctcagggatttcctcggtatgaacggtgagaacgatgcgttcgtcatctgcgccgcctccgagaagaaggccgccgacgccctcactcttgcggtcggaagggccaacaccgccctcgaaggcgtccccgaagagaccagggaccccctgcccgacgggaccaccaagtactcgagacccctccccggtgcggccaggatgtatccggagaccgacgtcccgcccacgcccatcaccaaggagaggctggagaggataagggccaacctgcccgagttccccgagcagatcaaggccagactcatgaaggactacgggttgaacgcccagcaggccgaccagatcgtcagacagggcagggacgacgtcttctgccagatctccgacgagttcggcctgtccgcagtagcggccacgacgttccagaacacattccaggagctggagcacgacggggtcgacaccgaccttttcacctacgatgagctctaccaggtgttcgccggtctgaaggaggggaagttcgccaaggaggcgatcccggcacttctgaaggagatggcatccggctcggccatggatgcggccatcaagaagctgggtctttccgcagtggatgccggggaggccgccgcgatcatagagaagatcgtcggggagcgtgccgatttcgtaagatccaaagggatggccgcggtcggacccctcatgggtcctgtcatgggtgccctcaggggaaagatcgacgggaagcaggcttccgacctgctcaccgccgccataaagaaacttcttggatgaggccggagggccgcccttcggggcggtccgacccgctctcttttcagatctgggtctttacgatatcatccgccgtccgcagacatggaagggaccgtatcctcgtcctttcgatgtccgttccgtttttacattcagagcagcagcataagcgttccgcatacgagcatggccagacctatccaggacttcttggacatcttctcgtggaggaagaccactgcgaatacgaccgtgaacaggatgctgagtttatctatgggtacgaccagggatgccggtccgtcctgcagggccttgtagaagcacagccacgacgctcccgtggccagtccggagaggacgaggaatcctccgtccctccttccgatggaccctatgtcgtgttgggtcttctgcatgaatactatcgcccaggccatgatgaggacaacggccgtacgtatggcggtccccaggttggattcgacaccctatatgccgacctttccgaggatggatgtcagcgcggcgaacactgccgagaggatggcgtagatcagccacgagtcgcgggtctttttggtctcatccacgtccttcctctctatcatgagcatggtgccggcgaacatgacgaccatcccgatcccggacaatgcggtgaacgattcccccaggaagatgaaggcgagtatcatggtcagcacggtactgctcttatcgatcggtgcgactttgttgacgttccctatctttacagctttgaaatagcatagccaggacgctccggtcgccaatccggacagtatgaggaacaaaaaggtcctcggggtgatgtcccccatatcgccgtacgatccgacgatcccgaccatggcccatgccattatcaggaccacgaccgtacgcagggcggtggccagattggagtcgacgtccttgataccgatcttggcgaagatggatgtcaatgcggcgaatatcgcagaaaggaaggcgaagagaatccacgcatcggccatgtcgctttgtatgcggatgcagtatatacggtggcggcatggtggatttacttccgatgtgccagcaggggttttatctccagtacctgcagtctttcgaagaacagggggagctccccaaggactttcacttcgtacccctccaaggtcttgtcgagaccggccctgtccatgagggacgataccaccaccacgacccttccgtccggcaggaggtgctcgggcgccccctccagaagccggggcaggggaccgagaccgtccggacctccggaccatgccttcgcaagttctccctcgtcctccaccgggagatacgggaggttgaagacgatggtgtcgaacctcccctctatgttggagtatacgtcggtctccctgacgtcgatatcgaccccgttggccgcggcattcctcctggcgagggcgaccgccctcggatttatgtccccgcagacgacatccgccccgttcagtgcgcattggatggatactatgccggatccggtcccgatctccaagaccttttctccgatgcgtatgtccagggactccgtcaggaagatgctgtcctccgatgggggatatacccccggatcctccgccatgtcgaggccgtccttgtactccattgtatcatggcaacatattcatggtgatattttattgtccatgccatgacatccatcgacatcctcgtcatcggacatctcgagaggggtgcggacggttccgtggtcccctccggtacatggtccacctcctcattggtaaggaccgacgacggccacaacatcgtcgtagataccagtcagggatatatgggggccgggataaggtcgtccttcaagcagataggcaggatattccccgaggatgtcgatacggtcgtcctcacccacgggcatcccgaccacatcgggaatctgggactgttccgtaacgccgaggtcctgaagttctccggaggggacccgatggacggggtgaccctcttggataccgagaaggagattgcgaaaggggtccgcttcgtgcgcactccggggcataccgaggactcgggatctcttttcgtggacgccgacaggcgctatgccttggtcggagacgcggtccctctgcaggagaatctggagaagaaggcggtccccgccttgaactgcgatcccgatgaggccatggcctccatgaagaggatagtgcagtatgcggacgtcgtggtgcccggccacgggaagccgttcggtatctccgctctcaagaggctttataagtaagacggactacatgtggacataggtgaaggaaatggcagatgatctcccggatacgatcctctatcagtgccccgactgcgctgatgttaccgaacataagatactgaaggccaaaatgggcaggtccagtgtgagcggtacgttccagtgcggcgaatgcgggcgcgtgttcaccgggaccatccggcttcctaggaagatcgaggtcaaggtcatgttcagcgaccaggatgtcaccgaggtcacccgcaccgtcctcatggaggacgagatcgttcaggtaggcgacgaattcgacctagacgacggccgccatgtacagatcacctatatcgacaacgccgagggcaagaggaggaaatcctgtcccgcccccgaagtgaaggccctgtgggtcaagagtttcgatatccttcatgtcaaggcatccatcaacgactacaagcgcacctatccaatgtacttggaggccgagccggatgacgagttcaccatcggcatgatcatgaacttcgacacctgggatgcggtcatacacgccatcaagaccaagacgaagctcatgaggaggggtaccgccgaggccagggacatcgtccgcatctacggcaaaaaactcaatggccagcgtccggaggagatcctcgtggacgaggacgagccgttcgacgagtcgctctacgacgacggtacgatggacctcgacgaatgattatcccgttcggcggcccggggtcttctccgggtcgtccggcaggatgcagtcgaggatgtcggatatgttctcgctcctcacagtataggtggccgcatccgacgtataggggtctgtgggattgaacgctatggacatggccgagttcttgaacatggggatgtcggtgaacgagttgccgagcgatacggtcctttcctgagaagtcccgtattcttcgatgaatttcctcacgaacactcctttgtccttcagatcgaccactacctccccctctcccgacagggtcccgtccgggttggtgaggactttgtcggccacgcagtcatcgaatccgtattcgttcttcagcatcttcgcggcgaggtcgatcccgccgcttattatgacgcacttcataccgcattcctgaagggccgccaccgtctcctgtatgccgtctatgacgggcatgttctggaagaaatgtatcaggtcgcgctcgcagatgtcgggtttggcggacttccatttggctatgtccctgcgcatgaactccttctcgtcgatctcctgattgatgaaggcctgataggcggcctcgttctccactccgaggctctggtggacccaggcccaggaacttctcagtttggtgaggactccgtccatgtcgaagcagacgaggtcgtactttctgcgcatggttccggggtatggcgggctagtagattagcgtttttcggacatcaacggttttatccttcccggtgcttcgcccggacatggacgaggatgtcaggatcgactacgagaacgggtactatgtaggtacagtcctggaggacggtgtgacggagaacgggttgggaatgttcatctggaatacgggcgagtcgtatgtgggatacttcctgaacggtgtccgtaccgggagggggacgttcagatggcccgacgggaaggtgtacgaaggggatttcctcgatgatacgcgttccggacacggaaaattgaaatggccggccggggacgtgtacgaaggggacttcgtcaacggcatattccacgggaagggaaggctgacatgggccaacggcgaatcttacgaaggggacttcgtcaacggcaagatggaaggcatgggcgtccactatgcggccgacggatccgtcatatactccggggaatggatccaagggtgcccgatgacggcagaggagtgacgtatccgtctccttttctccggaacggtgcatccgacgagaggggggggttatttatgcggcagtgcggcggacatcccacgtctgccgtccccctccgggatgtgccgtacgggtctcccatgtacgtccatccgcgtgaaggggaggatcccaaaccgcttcgtcggagacatcacaggtcttcttgccggatggccgatagacatcgtcgtcgacgccatcatacgaacgttttacagccgcagtcgtttctgccgacctttatatcaatcgaccgtattctccccgaccatatgcttacgataatcgggacaggacacgtcttcaacatctcggaccccatctcgttcatcgtcagacagtgctggcctcaggccgtttgtgtggaactggacgatatgaggtaccatgccctcaccggtgacaaggaggccctcaggaaggacctggaggccagagggatcgatccggacgcttccaaggaggagaggctcaagcagaccaacgccgcctaccagcagtcggcgaaataccaggagaagatgtccgcacagaacaagagcaccgcaggagcagacatggtggccgccatcggtgccggcaagtcgtgcgatgcggagatattctgcatagacaaggacgcatccgccaccatggaccgcatgtggacccagatgggccgcggggagaggatgcgctacaggctgtccgggatatcggacagcatcttcgggaagaggaaggtggacaggacccagaaggactattccaaggaccaggccgcctatatcgaggagatgaggaagaggtatccgaccatggtgagggtcctcatcgacgaaaggaacgaattcatggcctccaagataaaggaggtctgtgccacgcatgacagggtggtcgtggtggtgggggacggtcatgtggacggtcttttgaaacttctgccggaggaaggcagaagggtcgtcagactcgtggaactcatggatcccgaacgcgtcaagcagctgaagacccagtattgggaaggtgtcgaagaatgatagtcagattgctggcacatacgccggatgcggataggatatgtgcggccgcagcacactcgtgctactcggaggactccgccgcagacctcttggagaccgtggatccggccaagatgctccgtcatgtaataggtatggggcaccattccgtaatcgagcatgccgttttcaccttctccgtggaaggggtctcccgtgcgctcacccatcaattggtgaggcataggatcgcctcgttctcgcaacagtcccagaggtatgtcaggctgtccgagccgacatacgtggtgccggagacggtgaagagggaccccgaggccatgaaggtctacgaggagaccatggatgggatctgggactcctattccaagttgatcggcatggggatcccggcggaggatgccagatatgtcctccccaacggttgcaccaccaacataacgataacgatgaacgcccgcgaactccttcatttcttctccatgaggtgttgcaacagagcccagtgggagatcagggagatggcggacgagatgctgaggctctgcaaggaggtctcgcccgtcatattctccgatgccggacccgcatgcataaggggcccctgtcccgaaggaaagaagacctgcgggcatccccgtacggatatgaaggatcaccgctgatcctcgtcgactccgaagaccagggacctgtcggttcctttgggcagacggatgtcggtcacggaggtttcgtacagggaataatcccccatcttcctcagagagtctggcacatcgatcttcctcagggatccgcagtatgcgaacgcaccgtagcagatctcctcgagtccttcggagaaggttatattttcgaggtcttcgcagtatacgaatgcggatgccccgatcttcttgagactctcggggaggacgacctctttcaggcctgtgcatttggtgaatgcgcatttacctatggatacggtcccgggggccacttccacacggttcgcacctttgcctgcaggacacagtacgagtttcctgtcgatatcgtcgtagaccatccccttttccgagcggtatctgatgttgccttccgccactgtcaacgtcttcagggatacgcatccgaggaacgaccctccggtgaacttttctacgcccgcaggcagctccatggtcgtgatggcgcagttctcgaaggctccgaaacatatatgcctgagggagtctggcacattaacggtcttcaaggagtggcagtctctgaagacgtccttggacagacgttccacgccgcaggggatcgtcaccttcttcagggaggagcagttctggaaagctccctttccgatgctcctgacactttctggaagtatcagctccttcaggcacatgcagccctcgaacgcataatcccctatggtctccgttccgccgagatctatcttggaaagggattcgcagccctcgaacgcggcggtcccgatctcggtcacagacgaaggcaggacgaccttcgtcagctcccgctggtcttcgaaacaggcctctccaagtgtcgtcaccccctcgggtatcgttacgctctcgatttgggaaccgtcgaacgcataaccccctatgccggtgaggtaatacgtctcccctccgtactccaccttgtacttcaagaccggtttgacggaaacccccttgtattccgagacggccaccctcctgtccattccggtaacgacatactcgaagtccccgcttacgaaacagtccgtaaggaggaattccacattcttcggacagccgtacctttcggcccacttcagaagctcggcggcactttcgttgccggcgtccgccgccttcctccaccatttgacggccttcttcgcggagcgttccacgcccttcccgagatagtacatcttcccaaggaccatctgggcgtattcgtcgccttctttcgccgccttgggcatgaattctgccgccttctcgtagtctccgcggttgtatgccgcaatggccgcattgtattcttcaacatacttctcgttgtacttcccggacatggtgatcgtcctgtcatcggggtgtcggcttatcaatctatcacactgccgacgggtttccgagcgcacatggtggcggaaatcggaaatttcggcatatgctgaagccttcgttcttcgcaatgttttaaataaggaatatccatcagtcggattactcggtgaaagatatgggaagaataagacccacctacatcaagagagtatccatcgaactcatcaacaaatatcctcaggcgttcaacaaggatttcgacaacaacaaggaaatggtcgcaacccttaccgacgtccagaccgttccgatgaggaacaagatcgccggatacatcacccgctacctgtctcatcctgaggcatgaagggtaaaaccacttacctatccgtaaggatcgggccgcattaattccacgggcatatggggtagcttggatatcctaggggcttgcggagccctagacttgggttcgaatcccaatatgcccgccattctttttggccagcatcggatttgatatgggcggatttgtttcaatttgaaaatctcgtttccgccggcatttcgccatctatcaccaaatcgttacaaccgcaagaaaggaacgatcgattcttcgaactcatacccggcaagtatgacgtcaagaggatacagaactgaacattgtgaaccggacgcatatgcggtttgcgagtgcacgaggctaaacgtggcgacttacgcttcgttgattactcagcagcatggtccaatatatgatcttgcatcgggatgctcggagatcaaccaatatcatatggccatcggtttacggatcggacgagggcctgtcttcgcacggttgaaataatcggaactgctgcatggacccgtgttcggaatcggcagagtacgttgtgttttcatcgatgtcgacaaccgtgatgtcagggccgtggagatcgatgacatataggggcagtactgcgaggtaatacgctgcgacaacatattccgcatcgtgtgctccgtcggaggcacccgttacgctgtgtacggcgacaaggacgttctccaggaccgcagcgccgtcgtatcggcatattcgtccgaggggaagcctgtattgggcgggaatatcctgctgacccgtgtagggaacaggcgcaaggcgtccctcacggacaaggatatggcccatctgcagcagttcgtcaggaattgttcctccgaactctgtccggaggaacatcctgcgatattcggcctcgaattggagtgatcctcactcctcttcatcggtatccggtttcgggaggaccttccttacgatgtccacggatccgggcgggagtatcctcgatacttcttcctccggtacttcgaaagccttggcgatgtctccggccatcctgccgtttttctccttggaggggcggatgacatagtacttctcgctgcatttctccatcacaggggtgggggcgcacatgatcttgcgctcgttctggtaatagacctccccgatccccatctccaggggaagatggtactcgtagttcctcttccctctgatgatgaacgcccccctggggacgaactctccggcgttgggggtcttgctgacctggtcgggataggcccagaacgcccctccctcggccgatccggccatccaggccttggactgtgccagagcgaaccagcaggcctccctgagctcctcctcggatgccttgaggccgtccttcaggatgacggacggtgctccgtggatgtcggcatgtgcatagacatccccctccttcaggtgtttcttgaccacctggtcgttggagtgggtgtcccttccggctatgacgagtctccctcccgaggagatgaaccacttgtacgattcgaaccagaacctcttcgtcggtttggccttggccagttcggcggcgaccttcttatcgaatcccttctgcttcttctccagctccgccacggagtcgtccagggccttctgggcgttgtcggccttctcgttctgctcctttcctctggcgtagatctcggaggcgttggtgtctatgttcttggtatagtcgagttccacctcgaggatacctatcttcatggcgacgatgttcttggacgggtctatgtaggacacgtaggggatcttgagtgcaccctcggtgagtttctcccatgacagcttcttgcattgttctccgaggacggtcaggagttcggacaccttctggtattcggtgtaaagcgaatccgcctgcgccttgaggcgctcggcctcgacacggtatgcgtcgacggtctccttctgcttctcgatcctctttttgagtttctcgatctctgggtctacgaattcccgctgctcctcggcctcgttctctcccatgaacttcccgatggcctcggatatggtgggcatgggttccttcacgcaatcctcgtagatgtgaaggtccatgggggctatgtctacgatcttcccttcctggcggaatatcgtcgggtgcggttccctcatgacgtagtccgcgatctccatgaccgccgagtgaagggcatgtacggaggcgtcgtccgcatccttggcgggaacggtcttgtctacgccggcacgtttgcagacctcttccgcatactgtcctcctaggttgttgacggtggcgagggtcctgacggtatcggagtcggagcttctgaagagattcttgaaggaatcctcgtcggaagtcagagggttgaacctctccttcggcatcacgtattcctcgccgggacgggtggtcctgtcgcggaacgtcctctgggtaaggcagttcactatcttcccatcctgtaccaggaggacgttccctcctccgaacatctcgaagatgaggaggtattctccctctgccttgaacacctgcatttcgacgatacggtcgaaaccgatctgtctggtcttgccgatacgggcgttggtgagatatttcctcaggaatgtggcgaaggaggtgggggtgacaggggtatcgggcctgtcgggggacaggaacagccacttcttgtctttgaagaaaaggtcctccttgccgttcttggtgttgatacggaacaggacgttccccgctccccactggaagatcttgtccatgtgggcgttctccagggcggccatctccgtgaccacggagcggacgtcgaaagagctcatctccttcttcatgccccctcaatcgtatccactaataaaatacgctccacggaaggaagcggcccggaccgtggaccatgtggccgttatgaggtccgaacacacgtgtcaggagtcttcgggaccaataaccattaaatatcaatgttcatttagcgaagtttagtgccgctgtggctaaggggtatagcgacgccttggtaaggcgtaggccgagggttcaattccctccagcggctccatcttttccaatcatccatcatccggggtcatggccatatcgtctgtaacgttgtattcccttcaagacgatgcccggcctcggattgtgagtccggcggacgagtattcttcgaccgggaccacgatcgtccgatgtatccgggcgttcccggcagatatgaaaaggacgggccgaagcccgtcatgtaaaaggtattcactccatcctgtagaagacccagccggaccagatcttcgggaagaagaacgtcgtcttcttcggcatcctcttcccctgtcccgcaaggtcccagatggtctgcaggcagggtgcgttgaggactatcgccgcatcatgcttcttctcggccatggccttcttgacggattccagttcggcatcgtaggagatcttggatttcccctcgtcgctcttgtacactccgtaaaggatcttctgctgtgccgcataggtgtcgagtttcatcatgacgttcccgtcatcggatgtgttgtccaacaggaagcaccttccggacctgaacatcattccgaagagatgttccttcaaccgggactccatctcctcctccgtcacctcggtcatggtcatggccttgccgatcttctttatggcgctggtctctccgatgtctcctgcatcgatcagacggtgtgtgggccatatgaccaatccggcatcgtcctgggacaccatggtgcagaggacgaattgtttagcctcggaatccgggttctccttggcatagttaagggcggtctcgtacctgtggtggccgtccgctatcagcatcttctggtccctcagtttctcggagatctccttgcacagtccctcatcgcagatcctgctgtatctgtgctccacaccgttcccgtcgacgtacctgtaaaggagtctggcactgtcgtccaccttcctgtcgagctcctttccgagtcccgggaagatcccgaagatgctttcgaggtgggtctccatgtccctcagcagattgagcctgtccgccttgaccttggagaacgtctcctcgtgcggtatgatgttcccttcggagtactcctccgtccgaagtatgccgaccagtcctctcctggtgtaggtctttccgccgtccgagaaggtctgatcgtagatgtagtaggacggttcgtcctgtttcagggagccgtcggcgatcatctcgtcgagtctcttcctggcctgtgtgtatctcttgtccgcatcgggtgacaaggtgaggttggttacgttctccctcttcgactgcagctgtctgagctcttcttccccgatcacgtcgtacggaggggatacgcggtcggcgatcgtctcaccggcacggatgttgggtctgtagcccttgaacggaaggaatgtgaccatgatgttctcctgagtgggtatcagcaggggtgtcctataaaggttctacccctactccgagatgtcgggagaacgcggtcggaaaacagaggcggcggcacaagtccgccgccgatatcgtccgtcagcatatcctggggacggggtcgccggacggaggttcgaggatcctccttccgccgatctccgtacgcagaacgaccctgccgggtccttcggatgccttaccgatgatggccgcatcctttccttccggcgtggaccttatggccttcaggacctcctcggccatctcggggaccacggagatcacgcatttcccttcgttcccgatgttcagaggttctatccccaggagttcgcaggcgctgacgacgccgtccctgagaggtatgcactcctcgtctatgtccagctggcacttcgacttcccggcccactcgttgagggtgttggcaagccctcctctggtggggtccttcatggcgacgatcccgcctacgcggagacctttctcaatcatcttgttgagaggctgtacatccgattcgatgacgctgtcgaatccgtacccttccctgaacgagagaagggctatgccgtggtcccccatgtatccggagacgattatgacgtcccccgggcgggtgttggagtcggagcaccatctgctgtccaccttcctgtacgagttggcgacctccatgtcgtggtcgaggtagtccggtctttttccgatggccgcagtggatacgaccatcttgtccagttcccctgcgcccatgaccttggtgtctccggttacgatgggcacccctgcatacgcggccgtgtcgcccatgctcttcatgaccctgtccacgatatccgcgtcgagcccttcctctaagaccacggagctggctatcccgatgggtttcgcgcccatgacggagatgtcgttgactgtcccggacacggcgatcttcccgatatcccctcccgggaagaaaagggggttaacggtgtggccgtctatggtgaagacgacgtcgtccactaccgcggagtcgtccaaagcgtccagcggcacctccgtgtccattttggggaaatggctggtgatgtgcttcgagatgaactcctgcatgagttcccctccagcaccgtcgttcattacaacctttgacattgggacggtaatcggggaggttcgattaaaggatattgtgcgtcgtttgtccaatcataattaatagggtgccgacgatggtacggaagggcgtgtgtggtagcttggatcatcctatcagccttcggagctgacaacccgggttcgaatcccggcacgccctccatgttccataggatagttgtcgggggagggcccccgacggtctcagttccccggataggatatgagactctcgacgtcgtatcctttcaacgctttgttcttggcgtcgaatccggcgagttccatgacgaagccgatcttgacgacctttccgccgagtttctccaccatctttatgatggccgcagtggttcccccggtggctaccaggtcgtcgaccaggaacaccttcattccgggtctgatactgtccttatgcatctcgagggtggcgctgccgtattcgaggtcataggtctcggatatggtctccctggggagcttccctttcttcctggccatgacgaacccttttccgagggcgtatgccacaggcgctccgaagatgaatcctctggattcggaaccgaccacgatgtcgatgtccatcccttttaccatgtcgcacagctgatccaccgccattttgaatccttccggatccgatatgatcgtggttatgtccctgaacatgatcccgggtttcgggaaatcggggatggtcgtgacgcagtcctcaagttttttcgacatacgtcagcatcggttcgtaaggtattataggttgctggaaaaacgatctcttgggaggagttaagggggtttggccgcggatcgagggacctgagatgaccgctcagagacttccgcactgcgacgcgccaactggcccagcgtctttcttggcgaggagcctcatttcgatgtgcttccctccgcggaattccgacatattacgtttgcctattgttacgcgcctccttgagatgtatatcggattcacagtataaataatctatcttcgtactaaattccatcatttattacgaaaaacgtaataatgttaggtaaaaacgttatcgtacaagttatatgggggtatgtatgcggagagggccatctgaaaatgcgtagcctttcattcggaaaggtccaaaaaagccgtcatcgcctgcggatctcttcctctgcgaccttctttacatattccgcgttggccaaggtgttcccggcgatggcggggccggacgcatagaggtccagatccccgtccagagacatcgtgtatccccctgcctccttgacgatcctgctggccgccgcatagtcccacggagccaggttgatctcgaagtatatgtctatggcccctttggccagcatgcagagttcgaatgccgccgtcccggtccttctgatgtcctcacagatgtagtacagtttctcggttatgcggaagcattccggtgcgcgtgccttgttgtatgccgaccaggcggtggcgagcatggagtgttccaagtccctgtcggagacatgtatcctttctccgttcatgaacgccccccgtccctcgtatgcgtagaacgtcatatcgagatatgggtggcggacgactcccatcacgacagtgccagatctcataagtgctatggatacgacactgttctccaagcctctggcgtagttggcggtaccatctatggggtcgactatccatacccaggtgtcgctgcccctgagtctgtcgtcctcggacggaaggtccccttcctcgcccatgaagtacgatcccggaaggatcttcgacagttccctcctcagatactcctggacctttatgtcggtggaggtcacgtagttctccttggtccctttgctgtcgactttgaaaccggagtcgcagagtaccatctcgccggccttcacggcgaggtcgatgacatccatcattatcttttccatagggcaccttctgtccctgcagtccccgaagggggtaaatatgtatcgtctgggtattgtaaaaaaacaggccgggccggagcccggctcaaggtttacacaagttgctcggagcagtacgggcagaacttgggggtcttcttcagaccgctgaggtcctgtccgcagtacgggcagatcttgaacgccgcaccgccggccggggccgccgcaggcgctgccgcgggagcggactgtacgggggccgcggcctgctgctggttttgcatcatgggggacggctttccgcagttcccgcagaacttgtacgggtagtcgttcagtccgccgcagtacgggcacatgaccttctgggcctgcggtgcggcggcctgctgatggacgccctggacggactgctggctgagctgttggtacatctgggggaacaggagcatccctgcacccatggccgcgcctccctgggagtctccgatggcatccgccatgcggtccatgacctcgtatctcttgaacgcctctccgttggcgctgctgaactgcaggtactcgaacaccttggtcttctccgcctcggtggtggatacctcgttgatcttcagtgccaggagttcgatacccctctgctggaaataggggtcgatcaggatcttggtggaggtggatgccttctccaggttgctcatgacgtccatgtagtactggctgttgagctgctgggtcagctgttccgtgatgaagctcttcatgaactggttcacgtcgccggtggagtagctcttcattccgcccaggacctgggtgtagaacacgttgacgtcctgtatgcggaactggaagtctccgttcgccatcagggtgatggggacctcgtattccttggccgccttgatcatggacctgagtccccacttcccgttgaagatcttcagcgagatgaagaccacagagcatttgaagggggtctccctgaatccgagtgccttgttgtacagggcggtgagccaggggatgttggagctggtcgtcacatgtcttccgggttccaggattccctggagctgaccgtccctgatgaacagggccacggagtgctcgggaacggtcacggaggttatggtcctcaggtcgtcgtcgggggacacgtagattatgtcgtccggtccctggtctttccagaacacaacattctgtttcttctctgccatttatctcactccttcccgtctacgaagcccttcattatgttctctctctggttgtaggcctcgatcatcgcatcgatctccttctccaccgcacggagggccggtctgatgttctcgccggtgtccgcgtattggacgagctgtgcgctgaccgtcttgaggttctggactccgtcgataagctgggcgtcccacgagatgatgttgtcgagctcggtctccatgatcttgaccgagtcgtggaacgcgctgtatcctgcggccgccttcttcacgtccacatagtacttgtccaccttggccttgatcctctcggagtccctcatggcgtcgaggtcgcctatcgccgcacgggatgcgttcgacaggtcgttcttgacgtcgaagagttctttcgccacgacgtccctgatggccctgtcctcgtccctgcggaggttcttctgcttgtatcccctgtagaaggggacgtacatcgcgatcctctctacgagggacctgttcttcgccatctggccttctactttgttctctagtgtgtctgccatttccttccccttctcagaacttggacttcttgctgtttatgagccccgtggagaggccgatcagtgcgattccgattatgagcaccgctacggcgacccatatgctgacgtcgtatccgacgatgaccaggatcacaccgatcagtgcgatcacgaggccgagggccgtcctgtacatctgttccgaaggtccgaatttatcgggttcggaactgtatgtcgcacccacgacgaatatgtctatacccagtactatgaggaccactccgatcacggcggttatgccgactccggctaccccgtagaggatggcgcccagggctatgcccatcagcgccacggccgccattatgacgccgcgggtcctgtatgcgtttccttggttctctaccatatctatcccttctttttagtaagcgtgagttgtcgtcagaggatgaccaggttgtccaggtcggtcctccctatcctggatggtaccaggctcccgaagcttgacggtgccgttatcctattcccgtccttcctgcacgggatgtatatcaggcggtccacgtcggggttgctgagtttgagttttgattcggccgaggccacggcgttgacgtactgttccgccaagcgctccgcctccctctccgtgctcaacggcactaccacggccctgcttccggcggagttggggcttgcggacgacactattttggatatcccggacccgttgctgatggaggtctcgttgcccaggatgcctgcgaacgtcccgtccttgttccttacgctgaagatgtccgtcaccgcggaacgggggttgttgaggcaggcctcgtctatcacgaagtcggcggggatcagggcatcttcgtggacctccacggccttcttcttccacagggatccggtctggaaactgtatttcagatccacgtgccagaacggcacaaggatgtccccgtccccgctggctatgtttatcgcccccccttccttggccttaacggcctccgacatgttggagaagatctccgtgagtctgtctttgttgttcagcatgaatccccagttgccgccggtcgggaactggtatgagaagatgcgcctgacgctgtccaacgccttcaaggggtcccctcctatcgagttcacggatttggcggtcccctccaaggcctctatctgcttgatctcggtcgtgatgggctgtcccattatggcgaccttcatgttcccgatcagctgggtcttcgcctccgcgagtttcccctttccttggtcgaagaggagcagtgcggatgcgacgtcgccgttcagtagtttctcgcacccctgacatgccagactcagtccggagaagcgcaggcttgccggctcgtagcctttcagtcccttgaagtcctccgcggcggtgttgaagttgttggccatcaggatgtacctgccgtccttgtcctccctcaggaggtgggtgttgtttatgagcagtgcgtatgcatccgagatgttcttcgccgaggttacgagttccttgctctccacatccacggcgagcggagagaccccggtcatcttctcgctgaattcgaaagcctgtgcaggcgtatgctgggcctttatcttggtatcgacggtgaacggcatgacgagcatcgggttggcgagcagggaggtcagagcgaatttgtattctccgaattccacgtcgaccctcggcttgacgctgttcatgaatatgctgtgcctcgcaacgctgtcaacgctctcggactgtgccatgaccatgccgccggggacggccttgttgatccacgagcggacctgtcccatgagctggtcgagataggcctgtgcatcgaccctctgctgcgtagttccgcagctggaacatgtgacgtaggggctgtcccccgccacttctttcgcatccagcggggctccgcagtacttgcatctcagtgcgatcatgttctccatgcgatcacctcgacctcatcagcatctcgctgcggactgcggctatctcggcctgcagtctggcctccatggccctcatctccgataccgcctgattgtagtatcctctcgatatgtcgtcggccctgttggatatggcggagtagcacggcatgcagatgtagatcgatccgaatccgctgtccgctgtttttatgaggttgtccctctccctgtccctgaacatctgggatatgttgcttctgaccgccatgaaatggacaccctccccgttggccggccttccgcacagccagcactttccggatttggcatagcatttcatcagttccaggtccctgtccccggaatccccgatctgtctgcggaagttgtaggccaactgcatgtattccgatccctgtttggggtccttcatgaccacgccggtgcccatacattcgtacgccatggcctgcaggatgagggattccctggtgccggtggcctgcgtgttccccttcgcgatctcgtccaacttgaggggagcatccccgatcatgctggcgtatttggcggccagatcgatcatcgcctgtcccttggccatgtagtcgtaatcgaccatggacgaggctctgatctcctcgatgccgagggtgcattccgtcttgatggcctcggcgtcgatctccgtcagtccgaacttgaactggctctgtccgcacgcgtccagggcgtttatgaaggcctcgtagctgctcacatttccgcggttgttgttgaggtctatgagggcgatatacatcctggccatggccgctttgctggtgtctttggacagggcgtcgttgaatttccctttggcgttcccgtattccttcctgttgatgaggtcgataccctcgtcgtacagttggtcgccgctcttgaataacttgaatcccatgctcctcccccgctttggttgtaatcgaagattatattgccattcagtattagaaataatctcttcgacaccgtttatgtatgtgccagaatgtcaggatgaggttccgacgtcgaatgatcgcaggtccccgggaagtctgaaaagtcccatatggcacagggcccggtcatatttttcaaaccgcggtcggatgtgtatgtgtgcatcggcgggatgtgcttccggacacggtttgcagcaggcataatatttagtgccgttaatcaaaatatatgactattaacatttcttttaatcattgaagtattagacaaatgtctaattatttgaataaataatttgcaaaaatagatattttaccacaatttattatcaaaatgctcctcagccatgggaaaattatattaagagtatgggattaacacctctccatgcagactttcaggttcactgcagttgagaatgccaacgcaaaggagcccgtcgtcgcggtggcccccgagagcgagacctccgcctattacggacgcaacgtcttcaacagggcggcgatgagaagatatctttcggaggagaccagaaggtcgatctacgagaccgtcgagaggggggcgaccctcgacaggaacgtcgccaaccacgtcgccgagggtatgaagagatgggccatggacctgggggcgacccactacacgcactggttccagccccttaccggcggtacggccgagaagcacgattccttcgcggatccccgcggtcacggcgagtccctcgagaagttcgagggcaagctgcttttccagcaggagccggacgcttcctcgttcccgagcggagggctcaggaacactttcgaggccagaggatataccgcatgggacccgtcgtcgcccgccttcgtcatcggcgacaccctatgcatccccacggtcttcgtatcctataccggggaggctctcgactacaagacccctctcctgaagtcggattccgccgtcaccaaggccgccagggatgtcctggagtacttcggcgagggggacgaggtcatccactcctatctcgggtgggagcaggagtacttcctcgtcgacaaggacctgtatatgcagcgtcccgacctcgtcctcacggaccgcaccctcatcggccacgacagtgccaggaaccagcagttggacgaccattacttcgcggccatacccccgcgcgttctggaattcatgaaggacctcgagttcgaggcatacaagctcgggatcccggtgaagaccaggcacaacgaggtcgctccgaaccagttcgagatagcccccgtctacgaggcggccaacctggccatcgaccacaaccttctgctcatgtccatcatgaagaacgttgcggagaagcacggattcgaggtcctcctccacgagaagcccttcgcaggcatcaacgggtccgggaagcattgcaactggtccctcggcaccgagagcggcatcggactgatgtcccccggtaagaccgacgaggagaacctcaggttcctctgtttcatggccaacaccctcaaggcggtctacgacaacaacgccctcctgaaggccacggtcctcaacgccaccaatgcccacaggctcggtgccaacgaggcccctcccgcgatcatatcctccttcctcggtaagcaggtgagcgatgcgttcgcccagctcctcgccagcaaggacatggtgaagatcaccgggaagaagggatacagtctcggcataccgcagatccccgagctgctcgtggacaacaccgacaggaacaggacgtccccgttcgcattcaccggcaacaggttcgaattcagggccgtcggatccagcgccaactgttccggacctatcaccgtcctcaacaccatcctcgcataccagctcgagcagttcaagaaggccgtggacaggaagatcaagtccggtacccccgtcatgcaggcggtcctcgacgagacccgtgataccttcagggcatgtcagaacatatgcttcgacgggaacgggtactccgacgagtggaaggcggaggcccagaagcgcggtctcgactgcgagagctccgtccccctgacatacgatgcattcacgtccaagcagaccctcaaggtgttcgaggagaccaaggtgatgaccgaggtcgagctcgattccaggaaggaggtcttctgggagatctactgcaagaagatggccatcgagggcaaggtcctcagcgacctcaccaccaaccacgtcatccccgtggcgatcaggtaccagaacatcctcctggacaacgtcaggaacctcaaggacatctacggggacaaggacttcaggaagatggccgcatcccagatggacctcatcaagtgcatctccgaggacatctcggccgccgagagcctggtggacgaactcgacgccctcgatgccaagctgtccaacgaggaggagggccgtgccgccgccatactgtatcacgacaagatggcgccgatgctcgaagagataaggtcccatgtggactccctcgagatgatggtcgacgaccagatgtggcctcttcccaagtacagggaactgctgttcatccattgaaccgtaacggaagctgtgcgaatgaacgggaagtgtggcctttacgaccccgcggatgagaaggactcgtgcggagtcgggatggtcgtgaacataggcggagccaaagaccaccggatagtggagtacgggctccgtatactcgagaacctggcacatcgcggtgccgagaatgcggacggacgtaccggcgacggttccgggataaccctgcagatcccccacgagtacatactcaagtgcgggatcaaggtcccggaggccggacgttacggtacggggatagtattccttccccacgggaagaggaaggccgaggccgacatgtgcgtcctccgcgaggactgcggcattctgggtctttcggtcataggggagcgcgaggtcccggtggaccattccgtccccggccctctcgccctggagaccgagcccaccatcgtccaggtcttcatcagcagttacgatggccaggagaccttggagcgtaagctgttccagctcaggaagatggtggagagggacgtatcggaccccgagttctacgtatgcagcctctccacccgcacgatcgtctacaagggcatgctgacccctgaacagatccgccattactatctggacctctccgacccggacttcgtatccgccatagcgatggtccactccagattcagtaccaataccgtccccatgtggaagctggcacagccgttcaggatgctgtgccacaacggggagataaacacgatcaaggggaaccgctcctggatggaggccagggagagcattctccgcagcccggtgttccccgacataagtgcggtctcgcccatagtccagcccgggatgagcgacagcgcctccttggacaacgtgttcgagttcctcaccctgagcggattatccatgtccaacgccatatccgccatgatcccggagtcttggaacagcaagaatccgatcccggattcgctgaaggcgtattacgaatacaattcgatactcatggagccctgggacggtcccgccgcggtcctgttcacggacggcaggttcgccgggggtcttctcgacaggaacggactccgtcctgccagatatacggtcactgccgacgggcttttcatactggcctccgaggcgggggtcatcccggtgccggaaggggagacggccgaggtcggccgtctgatgccgggcaagatgatgctcatcgatacccaggagggcaggatcctctacgacaaggagatcaagggggccctcgcatccgcatacccctacagggattggctggagaagaaccgcatagacctcatggacgtgtcgtcgggacgcaccgtcgaccgctccgtcaaggatgcggagaggctgaagaggatattcctctattccaaggaggacatagacaggatcctcattcccacggtccagcagttcaaggagccggtatcgtccgcggggtgcgacatccccctgcccatcctctccgacgtcccccagctgttcttcaactacttcaggcagtccttcgcccaggtgacgaaccctgccatcgatcccatcagggaggagctggtcatgtcggtcaccggatacgtcgggtcggtgcacaacgacatcctgtcccccacccccgacaactgccgcatagtgaaggtgaggcatccgatcatcaccaaccgtgagatcgacctcctgaagaatctgaagtatcgcggtttctccacggaggtcatccccatgacgttccgcatctccgacggtccgaacggtctggagaaggccgtgcaggagatctgcaggaaggcagaacgttccgtggacgacggcgaatcgtacatcatcctctcggaccggcctgtagacaaggaccatgcggccataccgtcgctgttggcggtgtccgccgtccaccagtatctcgtcggaaagaagaagaggctccaggcggggatcatcgtcgagtcgggagagcccagggaggtggagcatatcgccctgctgttctcctacggtgccaatctggtgaacccctacctagcatacgagcagatagaggagctctgccgctccgggcggatacagtacgatcccgataccgccgagtacaggtacatccgcgtcctcgagaagggtctcatgaagataatgtccaagatgggcatatccacgatcaggtcctaccgcggttcgtgcctgttcgaggccgtaggcttggacagggggatgtgccagaagtatctttcaggcacagtgtcccacatgggcggcatagggatggcggaactcggcatggagataatctcccgtcatgtgtccgtgttttccggggagccggaggaactgcccgacctcggaatctacacatatcgcgccggaggggaaaggcacacatggtccccggaaacggtcagactcctgcatgcggccgccgccgacccctcggagtacaaggcattcgccgagaaggccgatctgggcgacggtctgttcttcatccgcgacctcatggaggcgaagaagggcagaccggtgcccttggaagaggtggaacccgagtcggagatcgtgaagaggttcgtcatcgaggccatgtcgttcggggccatcagcagggaggcccacgagaccatgacggaggccgcgaaccgtctgggtgcgaagagcaactgcggtgagggcggagaagacccgtcccgcaatgtgccagtaggtggaaggaacatccgttccgccgtcaggcaggtcgcttcgggaaggttcggggtcaatacggagtatctcgtcaatgcggaggagctgcagatcaagtgcgcccagggggccaagcccggcgagggcggacagctcatgggattcaaggtcgacaagataatagcggccacccgtcacaccctccccggggtcaccctcatatcgcctcctccccaccacgacatctactccatagaggacctgaagcagctgatactggacctgagatgcgtcaacccgaaggctaggataagcgtcaaactcgtgtccgaggcgggggtaggaacggtcgcatccggagtggccaaggccggtgcggacaagatcctcatatccggggcggacggaggtaccggggccgcacccatgtcctccatgaggtatgccggtctgccatgggagctcgggatggccgaggcccagcagaccctggtatccaacggtctcaggggccgtgtggtcctgcaggtggacggtcagatgaagacgggtcgcgacgtcgtgatggccgccctcctcggggcggaggaatacggtttcgccgcatcggtactcgtgtccatgggatgcgtcatgtgtcgcaagtgccagaccaacacatgtcccgtagggatcgccacacaggacccggagaagagggccaggttcaagggtacgccggagaacgtatccaattaccttatggccatagcccgggacgtcagggaacgtctggcgtccatggggttccgctctctgcaggagataatcggcagggcggacctcatcgagaccaggagcgtgtcggggaaggcttcctccctcgacatctggcccatcgcctccgtggctcctggccagaggacgttctccgaaggtcagccggatatgctggaaggcatactggacaggaggatggtggaggacgtcatgtccgatgcggaggccggcaggcacgtatcggcaacctatagtctggacaacacggaccgttccgtgggagccatgctctccggggagatccagaggcgcggaatggatctcagggacggcacggtggaggtcggattcaccggtaccgccggtcagagtttcggtgcattcctcgtcaagggggtctcgttctccctggacgggcaggccaacgacttcgtcgggaagggtctgtccggaggcaggatatccatattccgttccggccacagtcccagatgcaacgtcctggcagggaacaccgtcatgtacggggcgaccgcgggagagctctacgtggcaggccgtgtaggggagaggttctgcgtccgtaacagcggggcgaccgccgtcgccgaaggggccggagaccattgctgcgaatacatgaccggcgggcgcgtcgtcatactcggccgttgcggaaggaatttcgcggccgggatgtccgcaggggtggcctatgtactcgacgactccggcgatttcgaccgccgctgcaacatggacatggtggagctggagctcatggaggatccctcggactgcgaggagctcaaacagatcctggagaagcacgtcaggtataccggaagtcctctggccgcatccctcctgtcggattgggaggagagctgcaagaggttcgtgaaggtgatgcccgtcgggtacaagatgctcctcaaggacgaaagcaactgatctgggtctttgaaaaaaacatcgccgggggacgacccccggctttaaaggcggaaaagggtcactccttcttttcctcttccggtttgggatcgagatactcgaccggcgtggccttgagtcctacgacccctgcgatcacgacgatcaagaacacggccatcagccagttgaagtcatcgaggccgagtatggccgatactatgacggtcaggctgacaccgacccctatccatacggcgtatgcggtggtgaatgcgatcccgtgtctcatgggccattccatgcacaccatgctgagcgccaggaacactatcgtcacgatgtcccatgtccacacggtgaatttctcggtgtagtccaccccgatggaccatccgatctggaacactcctcccagtatgaggactatccatgcgatggtcagttcgctcttcccctcaaggaacttcatgtcagagacctcctgcaagtctggttccgattatacctatgacgataagcgccacgaagaacagtctcctcggggtaagcttctctctatagagtacacgtcctactgctacgatcccggtggcaccgatacctgcgagaaccgcatatgcgactccgggtccgatgtagttctctccgttgctgtccgtcataccgaccgcatatgcgagcagatacaggcagagcaatacgaggactactgcggcgatgccccatcccttgtgcttaaaactctctgatttatccaagcaggtgacccatatcggttcaatacagctggcgatgatgaggatcacccacgccattagctcttccattggatgggatttagtgtattttttaatattaaggaaattacgaacatgtatttgtcaatccatgccgttcgtattaacgcatatacggccgtataccgggccggtacgcggacggacaggtgcggtatttttccataaaaggataatccataaaaataatatcatttatcggaatgtgtagattcaataatcaaaatagggtagatttacaatagccagatattttttaaaatacatccaacttgtacttaaccataggttgtctactatcggaatagttatatagaaggactaaccatcaaggtaatagattccgccgagcacggcggatagttcggagaaattactatgggtatgggtaacgcacctgtgcttatcctcagggaaggcaccaagagagacaaaggaaaggacgctcagttcaacaacatcaccgcggcaaggaccatcgccgatgccgtaaggagcagcctcggacctaggggaatggacaagatgctcgtcgactccatcggcgacgtcgtcatcaccaacgacggtgtgaccatcctcaaggagatggacgtccagcaccccgcggccaagatgctcgtggaggtcgcaaagacccaggaccaggaggtcggagacggaaccaccacctccgtcatcatcgccggagaacttctcaagaagtccctcgacctgatcgactccaacgtccaccccaccatcatcgccgccggatacaggctggccaacgagaaggcgcaggagatcctgaaaggcgtggccaagaaggtctccctgcaggacgaggccctccttgagcagatcgcggagacctccatgatcagcaagcaggtcaactcctccaagaagttcttcgccaagatggtcgtcgacgccgtcaagaccatcctcgacaaggacgagaacggaaagtacaccgccgacctgaagaacatccagaccgtcaagaaggccggagccaacatggaggagtccgagctcgtgaaaggactcatcatcgacaaggagcccgtctccccgaccatgcccaagctcgtgaagaacgccaagatcgccctgattgacgccgccttcgaggtcaagaagcccgagatcgacgcaaagattcagatcaccgaccccgagatgctcagcaagttcatcgccgaggaggagaagaccctgaaggacatggtcgacgccgtcaagaaggccggagccaacgtcgtcttctgccagaagggaatcgacgacctcgcacagcacttcttcgccaaggaaggcatctacgcatgccgccgtgtcaagaagtccgacatggagaggctcggaaaatccaccaacgcatccatcgtcagcaagatcagcgagctgaacgccgacgacctcggaaccgccgagaccgtcgagctcaagttcgtcggcgacgagcagatgaccttcatcaccggatgcaaggaccccaagaccgtctccatcctcgtaaggggaggaaccaaccacgtcgcagacgaggtcgagaggtccctcgtcgatgcatggtccgtagtcaaggtgtccattgaggacggaatgatcgtcaccggcggcggttcgaccgccatggagctcgccatgggcgtccgcgactatgcggcatccgtcggcggaagggagcagatcgccatcgaggccttcgcatccgcaatggagatcatccccaccacccttgccgagaacgctggtctcgaccccatcaacatggtcatcgagatgaggaagcagcacaaggcgggcaagaagtacgccggaatcaaccccttcaccggaaaggtcgaggacatgatggacctcaacgtcatcgagcccatcaggatcggccagcaggcgatcagctccgcaaccgatgcggcagtcatgatcctcaggattgacgacgtgatcgcttccaagtccgctcccgcccccgcaggcggagcacccggaatgggcggaatggacgactaagccttctaaaccctaatcaggagggggcttaggccccctcaccaaccatacagttcatacaagaggttcacccgatgactgataagtctgaaaagaaagacgagaaagcccccgagcaacaggaggtgaaagaggcgaagaaggagaacaaaggtcagaagaaggagatcgacgagctcaaggcccgcctcgaagaggagaaggagaactccgccaaaatgctcgacatggcgaagcgtcttcaggcggacttcgagaactaccgcaagaggaccgaaagggaatccgaggaatataggaaatacgccacaaaggacctggtgtcggaactaatcaatgtggccgacgacctcgagagggcgctagcctcggtcaaggaggaggatgcactgtccacgggcgtcagggccgtcaggggcaacctgatgaagatcctcgaagcacagggcctcaaagagatcccgaccgaggggaagttcgatccaaacatgcacgaggccctgatggtctcggaaggcgacgaggacgacatggtcgcagaagtgtaccagaaggggtacatgatgaacggcaaggtcctccgctacgcaaaagtcagagtcaccaagaagaaacaggatgctccggcggaggaggaatccgccgagtaaaacagtttaagcgaaatcaagaggtgtttgaaatgtcaagaataatcggaatcgatcttggaaccagcaactctgccgcctccatcatggagggaggcaggcctaccgtcatccccagcgcagagggtaccagtgtaggagggaagtccttcccgtcctacgtggcattcaccaaagacggacagctcctcgtcggagagcccgccaggagacaggccgtcaccaaccccgacgggaccatcaagaacgtcaagaggaaaatgggttccaacgagaaggtcaccgcgctcgggaaagagtacaccccgcagcagatctccgcatacatcctgatgaagatcaagaaggacgcagaggccttcgtcggagagaccatcgacaaggcggtcatcaccgtccccgcatacttcaacgacaaccagaggcaggccaccaaggacgccggtaagatcgcaggtctcgatgtggtccgtatcatcaacgagcctaccgcagcagccctcgcatacggtctcgacaaggccggacagtcccagaagatcctcgtcttcgacctcggaggaggaaccctcgatgtgaccatcatggacttcgacgacggagtcttccaggtcctttcgacctccggagacacccagctcggaggatccgacatggacgaggccctcaccaactacgtcatcaagcagttccagaacgagaccggcgtggacctcaacaaggacaatgccgcaagggtcagggtcagagaggccgccgagaaggccaagatcgaactgtccaccaccatgcagaccgagatcaacctgccgttcatcaccgcagacgcatccggacccaagcatctggtgcagaccatcacccgtgccaagctcgaggagctcgtagagtccatcgtcgagaggtgcaggggccccatcgagcaggccatgtccgacgcggacctcaacgccgacaagatcgacaaggtcatcatggtcggaggacctaccaggatgcctatcatccagaacttcgtcgagtccatcgtcgggcccaagatccagcacggagtcgacccgatggagtgcgtctccatgggtgcggccatccagggagcggtcctttccggagacgtcaaggacgtcctcctgttggacgtcacccccctgtccctcggtatcgagaccctcggcggtgtcgccaccaggctgatcgagaggaacaccaccatccccacaaagaagagccaggtgttctccaccgctgccgacaaccagccctccgtggagatcaacgtcgtccagggagagaggaagatggcctccgacaacaccagtctcggcaggttcgtcctcgacggcatacctcccgcacgccgcggagtgcctcagatcgaggtcaccttcgacatcgacgccaacggtatcatcaacgtctccgccaaggacctcgggaccgggaaggagcagaagatcaccatcgcatcctccaacaagctgtccaaggaggacatcgacgcagccatcaaggatgcggagaagttcgccgacgccgacaagaagaaggaggagctcatcgacgcccgcaacggtgcagagaccatggtctactccgtccgcaagtctctgaccgacctcggggacaagatcaccaacgaagagcgcgcccccatcgagtcggccatatcagacctggaggccgcggccaagaccgacaacgtcgaagacatcaagaagaagaccgacgccctgatgaaggcgatggagcccatcagcgagaagatctacaagaacgccacccctgaacagcagcaggccgcccaggaagccgccaaggcataccaggagcaggcccagaaggccggacagcagtcccagaagaccgatgccgggtccaagaagggtgacgacaacgtcgtcgacgccgactacaagatcgtcgacgaccagtgatccacagaggtaaattccgatgcccgaagagaaaagggactactacgaggtcctaggagtatccaagaccgcgacccccgacgagatcaagaaggcctatcgcagtctggcgaagaagtatcatccggacgtgtcgacggagcccaaggaggtcgccgaggcgaagttcaaggaagtctccgaggcgtacgaggtcctgtccgacgaagataaacgcaggatgtacgaccaatacggtcacgccggtgtcgacggacagttcgggcagggcggattctcctgggaggacttcacccacggagacgacctgaacgacatcttcggggacctgttcggagggatgttcgggggccgcagaaggcagaaccccgacgccccccgcacgggggaatctctgcgctacgacctcagcatagatctggtagacgtcctcaagggcaagaccgtccagatcaatgtgccgcacacgtccgagtgttccgactgtcacgggaccggcggcaagggcggaaagacccagacctgtccgatatgcggcggcagcggacagcagcaggtgcacgcccgtaccatgttcggggacaccatacaggtgactacctgcaggcgttgcaacgggtccggaaggacgtattccgaggagtgtccgaagtgccacggccgcggaagggtcagcaagaacgccaaggtcgacatcaacattccgcccggagtggaggaggacatgcgcctccgcgtctcaggggcaggggatgccggatacaacggaggacccagcggcgacctgtatgtcgtgatccacatcaaggactacaaagggttcaagagggacggcagcgacctgtgggtcgatgtcgacacgacgtatccgaggctggtactcggaggggtcgtgaaggtcaagaacatagaaggcaaggagatcgaggcaaccatcccgtccggtacccaggtgggaggagtgctcaagatcaccggtcagggtcttccgtcggtcggacgttccgcccgtgggaacctctatgtgcgcctcggtataaccgtacctaaaaggacctccgattatgaaaaggagcttctccagaagctcgatgaggaggcaggctccaagaagacccgcaagtccaagataaaggacaagctcggcatctgaaaccgtttcacgcccccgtcagggggcgcggatattttcaattcaaaagtgccagatgtcagttgaacatggggtccttgaaactggtatgctcggggatgagtttcttcaggttcccgtcattggcgtccactatgtccacgaccatcttcgttatcgagaggatgacgtccttcgaaggaaggtactccgcgaacatgtgatggtatctgtatatcacgcgcccgctttccggatccaatacgaacgctccgaaatgcagggtgctgttgatctcgttgagtcctcccattatggcgctgtagcttccggcaggagcctggaaatccaggagggcgtcgaagcacagtatgggcatctcctcgttgacgctgatggtcagtttgatggggaggtcgtcacccttgaaagtgctgtagaccatgaacttctcttcgtccctgttgtacttgatgtccttggaatcgaaggcgctgcatacgtccttgtacactttgtcgggcctggaaccggccgtcttcttcttggctccgaacatgatgtctccatcccagtacttgctgataaatcctgctcccaggtatgcagggtccgatggatgagatccgataatggttccactcgcgctatacgcatacgagaagcatgggtacggaaaaagagccagtcgttgtaagaacgtcctttctagatgcctgtgtttccgatggaggcggataccgacattctatgtccgtccgtatcggaagatcctgttggagggatcgcacggccttggaattgccgaatacagcggcctcagagccatactttataactgatgctaccatacatgtaagattatgagcgaatcgtacctctgggtcattttcataatcgtcttcctggcgataatgatcaccgacctagcagtggtcgataaaggcgctaagaaggtcgatacgaagaaagccgccaagatggtagtgatctatatcgccattgcgcttcttttcggccttcttatctatttcgaactcggatccgatctcgcagcctcgtactatgcggcgtatgtgatagagttgtccatgtcggtggacaacctgttcctgttcatcatcatctttgcagccttcatgatacccgatgaagaccagcacagggtcctgttctgggggataatgggtgcgatcttcttccgtgccctgttcatcatggccggtgcggagcttctccacacgttcgactggatgatgtatgtgttcgggatcatactcatctacacggcatacaagaccgcgtttgccaaggagggtgacaagaagacggaggacacccttccataccgtctgagcagacgcatcaatgccacacccgagcttcacggggcgaagttcttcatcaaggagaacggaaagcgtctggccactccgatgttcctatgtctcatcgtcatagagctctccgacctgatgttcgcattcgattcgatcccggcggcattggcaatatcgacggacatcttcgtcatctatacttcgaacatcttcgccgtcatgggtctcaggtccctctatttcgtcataaaggacgtcatcgggtccctcaggtacctcaagtacggattgggggtcatcctcgccttcatcggtgccaagatgctcctcgcggcagcggacatctgcgagatctccgtggtcgtgtccctcgtcttcataatcaccgtcctcgccgtgaccgtggccacatccatggccgcatcccgcaaggacaagaagagcacggagtatacggagatagaaaagaaggagtgagatgttcgccgtcacgggagggacctgggggaaggaaggccttctcaggctggaaggggaccccgtcgtctcgtccatgtccaagaaggacttcctgatcatcctgggggactgcggggtcttcgttcccaggaccgccctttcccggacggtgagggagtaccgttcgctcccgtgctccgtacttttcctggacggttcccgtgacgattacgacgccatcgcagaccagccgccgttcccatggaacggagggatggtacacatggtctcccggggattgatccatctgaccagggggcaggtgttcagactcgggggcaggaccgtcctgaccatgggcggggcatctacgcccggacgtacagattccgggaaatattgggattggtggccggagcaggacccttcctccgaggatgaggagacggccgtgaggaacgtggaaaaggcgggaggggaggtggacctcgtactcagccgcgattgtcccagatcgtggttgccgcccgcttcccgcaatgccgggtccgtatcgtcggacgtcctggagtcgcttctcggaaggatctcgtacggccgctggtatttcggaaacgaaaacgcggatgccgatctggacggcgtccatgcttccgccgtctgtcgcagggtcatccccatagcctgaaagcgtatatgtcgggtcccggatatctggctcatgcaggatccctattcccgtgagttggaggtggcggcggacgccgttcgcagggcggccgacagatatgtccgctccgacgggggcccctccgaggagaaggagaacgcggtcggttcctacgacctcgtcacgtactccgacaggcaggcgcaggaagacataatacgcacgatatcggccgaatttccgggcgacctcttcatagctgaggaaggtgaggagaattctctcacggatgccaggacatgggtgatcgaccccatcgacgggacgctgaactatgagagggggatccccatgttcggtacccagctggtcctcatggtcgggaaggagcccgtcatgtccgtgatatacctgcccgttccggaggagatgttcacggccaccgtggccgacggtgtgaggctgaacggcatgccggtgaagccttgcggaggacatgaccttaagaaatgcatagtctccacgggggacttctcccggaagaagcaggagtggagggatatccattatgccctcataggtgcgatgaaggacgaggtggcccgcataaggatgttcggcgccgcatgtgtggatttcgcatatctcgccagcgggaggacggacatccacatacgtttcgtgaacaagctctgggacttcatgccgggcctgttcatggccagggtgtccggcgcatatgtggacgaagagcttctttcggagaaaagattcctgctcctgacgaggactgcggaggaagcttcgcaataccgggacatcgtattgtcccagatagacatgtgacggcaaacattcttgacctacgttaaggatacgtgccaggaggaaagagagtatggcagcgaagaagaattccaaagccaagaaagaggattatgatccgaacgccccccatgaggcgggcatgaagattgatgtcaaagacggtaacgaccatcagatgtccaaggatttcaccgtggaacggataaccgcggccaccatggtgacgctcgcctgcaacaccgtggcgcaggcgctcaacaccgaggaagggacaccctctaggaacgccaccgtccgcatgtgcaacaagaccttcggggacatgaggaagagtgccgagacctgcaggaaggccggcgacgatttcgtggccgatgtattgggaaggggtatagccgcatacgaggattatatcgcgaagcatgaggcatccgaatccatgaaggccggggagcccggaagggccaacgcgataagggatgcttccgacgccatggaacatctcgccgacgtgatgaacgaccttctccgtgcgttctgaggccgttccggtccagggtttccgacggatccggccggcggcgaagcctgcaatcttgaaataccattgcacattccgccggtcatcatgtcttcaatgaacggacagaggcgtctcggttccgggacgtttctcctattggtgatcttgctgggagcgttcggtcccatttcgaccgacatgttcctcccggcgcttccggacatggtcgacgagttcgacacgaccgccgcggtcatgaatatgccctttacgggttcatgctctccatggccgtatccatcctcctgttgggtccggtgaccgacaagtacgggaggaaggctccgctggtcatatgtttggcggagtatgtcgtcaccacgctgctgtgtgcgttcgttcatgacgtaggtatcctcatcgtcctcagggttttgcaggccataggggccggtgcggccatgacgctctccaccgccttcgtcaaggactgctattcgggagccatccgtctgaagatcctcaacatagtggcgatcgtaggcgtcctgggacctttgctggcacctatcgcgggggccgcactgatctctctatgggggtggagggccacattcatcgcccctgctgtcatagccttcgtatgtcttgtactggcacttatgttggatgagactttgcccgacggggagagggtggacggaggactgtctgacatgttgcaggggatgaagcagctgtgctgcaccccttcgttcctggtctttaccgtgatgatatgtctgttcaacctgccgttcatggcatatctttcggtatcctcgtacatctacgaggggatgttcggggttgagcccgtggcctattccctgatactggcgacgaccctcatggtgggcaccgttgtgatgatgctgataaacaggctgaccgggaacatcgtaaagcgccgcatcatcgggctctatctggtgttggggggtttcagcggaatagccacccttctggtcggggacacggcatggtatgtgttcttcgtatgcttctccgtatgtgtggcggtcaacatcaccatccgtccgtggggcatggggatattgatggcgagtcacgacggggacagcggtgcggtctcgtctctcataaacttcatgttcttcctgatcgggtgcatagggatggtcctctccacccttccatggaaggactacgtcttcggtctggccgtccttatctgtatatcctcggccctttacgctcttctttggacggtcttcaagacgggccggatggagctcaaggggttggacggcacctcttcggaggtttccgagaggcgctgacctattacatgtaatgccggcgttttatattcccatccgggagtcttagaaacatgtctttgactaccggatgcggaaaggataggctgatggtctttatcgacctgcgtaatgtattggacagttccttggatgccatgggtgcggaagacggcgtcaccgtcgatctgtgcggacttgtcaacgggctcgtcggcggaaggaatctcgtcgcggcatatgtctacgatgccagggcaccctatgggacggaagacccttccaaaagactccgtgacagattggagtatctgggattcagggtcgtcgtcagggattcttgcgatcccaacaggggggtgcagaaggaggtggacgtatgtctttcctgcgacatggtggcacatgccctgatggatcatttcgataccgcggtcgtcgtttccggtgaccgggatttcatccccgccatagagcatgtacagtccgccggaaagagggtggaggtggcggccttcaggtcctctgtaagttcgtcgatggtgcgcgccggggatatgttccatgaactagattccatgccggtgatgatgccttcccacagggacacggacatggccttcgggcatcagaccggaggcatcgcatgaccgatcccggcagtgtcgcggacctcgaacacaccccttatgaatcggtgtccgccgtaagtttccacaccgatcgcaaaggaaacgtctcaggcaggttcagaggggcggtggtgctccgtgacaggtcctccgaggagatcatccggccgggggagacatggttctgctcccttaggctgaacccgataagtctcggcaattatttcgccagggcgataaggaaggtggacgcatcgttcttcatggagttgggggagggtcagaagaaggagatagcggaggccctgtgggagaacagcaggagcgagatagtcccgttgataatggagtcccatgcggtggacagggatgtgtacgagaagacatccgagggatacgagaggaggataaaggagcttaccgacaggttggaggcctccgtccccgtgacgaaaggtgtggatgtgccggatgatgcaggtccgacgataacagatacgccccaggggttgttctcgtccctattccgtacgggacgttatgcggtgcgtctgagtgccgacgggaagaatctgcttctcactccggatgagcggggggaggccgaatgcagaggtaacatattgatgggtcacagactccgcgatatgatgcctttctgcggaagaccgtcgatcccttgtaagatatatggggacggggtcttggtgcagcgttaaaggcggggtgtggcgggagttccatgtcccagtgtagcaagggcatgttcagcctccttgcaaccgttggagacggctcttcccagccacatcctggctttgtgtatggaatgtctctcccaggattcgtccgcataaagggtccccagactgtattgtgcgtccggatcctcctgcagggcggccagggtaaggtagcaggaggccttctcgacatccctgccgaatacgtcattctccatcatgtagatatgacccagatgggtctgtgtggaaacatctccggagtctgcggcttccaaggcacggaaaagatggaacatcgcaccggccgcattcctctgtgtcccctggccgttggcatacatccatgcgaggtagatgtccgaggggccgtggccgcgatcggatgccagggagaaccatctgaatgcttcgccgtagtctatttcggtacctatgccgcagtaatatgcgatcccgagtttgctggcggcctctgcggacccctgaccggaggctctgaggaaccattccatggccttgtcttcgtccttgtccacgaaggttccgtttatgtacatggttcccagtccgcattgggctgcggcgtttccatcctcggccaacgattcgatcttttcaaaatagtcttctgcagattgggcacacataatggatattacatccatccatagtattagagcttatcgcgaatctgttcgtctcagaccggtctcagaggagtctggctttgcccttgagtttcttatagaagtctttggtgctctcgacgttgcccatgttgaacacgacgtgcttctcttccccgaattccaggacaatgagcagtttggctgtcacatggaagatgacgtcgtacgatccgtagtcatcgttcttgaagttcccgtagtgggacagggcaccgctggtgccggtgatcatacggcccaggtcgatatcgtccctcagcttcacatccttgatgtccgtgtagggaatctcgtaactgaagtatttggacttgaagatgaatgcgtcttcttccatccttatatcgttttttgagaagaatcccatgtccaacctaatcggataccgttcatttataacttcgtttattgcctgacaccgacgaaagcgacccagttcttgtcttcgttagtgaatgtctgggtctttaatcccgccttctccatgaggctcgcgacctcttcgttgggcaggatgttcataccgtacttcaggcatgcctctttcagggcctcgtcgttcttaccgttgggatactgttcggagactatcagcatgacccctccctccttcaggcgcgatgcggcatgtgccagatccttttccaggtccggccagaagaagtatgtctcaatcgccgtgaccaggtcgaagctcttctcggggaaaggaagatcggagacgctagccacctgggcgtcgatcttcccccagctgtggtatactgcattgcggtcgagggtgactttgacggcctcctcggatatgtctatgccgtcggcatgcgcattggggtagcgtgtcgtgagcatacggagacagttccctccgccgcatccgatatctaggatcttcttcggtctgaggccttcgatggcggagatctgtcccagtccccatgacgtgagttcgcggtggtgctcgttcatctcctcgatgaccttgcgtccttcatctccctgcgggttcctatactggtcctctttcgccatttctgagccttccttaacaaacgatgtaagcggtttgattaatatgttttcaatgctggcacagttcagatgaactttaccgcggtcccgtatgcgaggatctcggcggctcctgcggcgacggtggacgattcatacctcatcatgaccaccgcatcggcgccctgtctctccgcatcctccatcatcctctgtgttgcgagctcgcgggccttggacgtcatctccacgtatgccttcagttctccgccggccatcgatctgagcccctgggttatgtcgcggccgatgttcttggtctgtatcgtgttgccttgggcaatcccgattatctcgtactcttttccagggatcttttcggtcgtggttattatcgtttacaattccccctgtacgtaatgtgtggtacagggtaaaaacatgtgtctgtgttcatcagggatattctctcggaggagccgataagattcctgatgagcatgttgtccatggcaaaagggcggaatatgcagtcatcaaagagcatgaggtggttgccgatgatgggccgccgcacgggatcacgatggtgaaggtgtcgaaacgtaacgtatgcggacacatggatatgtccgactccgtgaagatccgatgatcaggcaaaggtcatcgatgccaattccagaagaaggctttgcgaggaacgggaagccggccatccgcacaatgctccgtcggcttccgtcctgtcattccatcgatatgtgttatctcccttttctgtttttaagaggcattttagcagtagtttcactgcaaataccccacttaaaaatagtaatgtgtccgaattgtgatagctgacgtatggagcgcaagatctatgccgagttgctcgagtggaaggacgatcccgacaggaagccgatgatcttgctgggttgccgtcaggtcggcaagacattcattgtcatggagttcggcgacagggaatatgaaaacatcgcctacctcaatttcgcagacaatccggatgacagattgctcttccagggggatttggatgccgacaggttggccgacaggataattctctccaagaatcttcctgcggatggcaggatattgctgatattggacgagatacaggaatgtgacgatgtgtattattccctcaagccgctttcatccaaggtatataaaaacctttcgtatctttatttatagtcatcttcttctatattataaagattgttattcatatgacgcgatatcttccatatcttccgccatatgactctccgattattatcactcttccgtcaagcggtatcacttcttaaaaattatctccatattctttctgagattatcccgttattatctcactccctccctgtcagttcgcctccatcatcctagagggtttatggaacagggccgaaggtgaaaattgaaaaacgaacgtaattctggaaaggtatctgaatacctccaaggggaagttaggcccgtaagggccgtttatggaaggtgtttacggaccattggggtcacggacgactctaacagaggggaatcagaagcagttatcgaggtctatcgccagccgacttccttcatcgaccgcgtcggagagaagagaagatgtggcgaacgaatccttctcggtaccgtggccgttggcgaacattatcgccagtttcaccttggcttcagtatgtccgttggacatagcgagatagtaccattcgaaggcaagggcatcattgcgatccaccccgagaccgcggtagcagatctccccgagatagtattgtgcttccccgtcacgacaggcggtcatgaaccattcccttgctttctgatatgactgttccactccggttccatggaaatacatttttcccagatccaaactggcaccgacgattccctgttcagctgccttcgagaaatatccgaaggctttttcgggacaatattcgacaccgaatccgtttgcatatgcaatgcccaatgcatacatggcctacgcatctcccgattcggcagcccttgtggtccagtagacggccctttcgatggaatcttcgcagggaattatgtgtaaatgatagcagttcgcaagagtattcatcgcacggacgttcccggattcggcgatatcctccaggacatcggcatctaccgagaggccttccgattcctgtattgcaagggcatcgagatttccttcatccgcgagcctcttcaacagggcttctgcctgttcgagcttctcgggggattttccacgttcttcgggagttgtattgtctatcgcttccttacagcgttcgtctcctctaaggtatgctccggccccactgcggtacatgtacatggccctgcacaggcccgtaagatctccctgttccatggcggcctcgtaccatttcagtgcctcggtgaaggactgcgtctttccgcatccgcggtacaggagatatccgtagtcgacctgtgcttccgctattcctccctcggcagccatcttcagccaatcttcggaatcggaatagactccaagcctgtacagcatctttccgagtgcatatgcctcttgggggttttcggggaggacgggatcggaaggtgcattgtcgtttccgaggaattcattggctttttcgtagaagatatccagagagtcgatttcacggtacttggtaagggatttcataaattcgatgatgttcagttgcatgaaccatttggtttcgttattgtgtgacatgttatcttgataaatctatgctcccggaggagctgcataatacaatgcggtcgttcgaaaggacaatcggtccgccatacattgcgtgatgaaatcgaaggattgaacggcacagagttcccactgacagggcatgtcggatcgcataaccctgttgcctcttcgccgaccatgttttccaatggcgttcggaggaccttttcccttgagttccgaggtaatcggttttgaggcactcaacctcaatttctgccatcattttgatgataatcaactcatcattttacagtacaattattattgatacagttgtaagattttctgatatcattctcagaccatcttgaaattatgagaaacaacggcatcatcaaatctgccaacctgcatctgactggaatctgcaactacgactgcgaacactgcttcgcaaggaacctgtcccgcaagcacatcactcccgcagagtgggaaccgatcatcgactaccttgcgaagataggagtcaccaagatcaacttcgccggaggagaacctgttctatacccgcagcttaaggaacttgcttccctggtgaaatccaaggggttcaccaccagcatagtcagcaacgggtccctcatggatgagaaatggttcaaggaaatggacgggctccttgactgggttggtctgtcggtggactctccctccgaagaggatgagatcgtcatcggaaggcactgccgcggaatcaggcatctcgagaatgtcgtcagggtctctgaaatggcccatgtgcatggcatgaaggtgaaactcaacatcaccgtggtaaggaggagctggaacaaggacttccatcccctcgtatcagccatgaatccggagaggaccaaggtatttagggccctcaccctgaagaacgagaatgatgacattcctgatgtttggtccataacagacgaacagtttgccgattttaagcagaaacactgcgatatcggaaacatcgtattcgaggacaactcggacatggtggacacctatctcatgttcgatccacttggaaaatggatggtgaacaacgaccagatcaaggcatacctgccttttgaaatcctcagggacaagggtgtcgagtatatgctcgatgtcgagaagtactacggccgcgacgcggtctacgagtggtgatcctcgtggataggatcgcagtgttcggaatctcccgcagcgggaaggattatacaattgagggtgccgtggacaggctaacggccgcaggaaaaaggtattgtcacctttcgatgatcggaacggtccatgacctcctcaaggggaggaaactacgtgaaatgagcaagatggacaagctggctctgatggatcgggtacatatggagatggattccatctctctgatgtgcagcactatcgtggatgaacactactgtttccctggaacctacgggggaaaggtaatacacaccgattacactgaggaaaaactcccattcagagagttctacgatgaagatctggaatccacttacgaaatcgtcttcgatgaatcagaactgaagaagtatcggcttgtggtcttcctcgacatagatccagaagttgtcctggaaaggttcagaacctcggaagggtgcaaacacaatgactatatcgccctgaaggatgtgaagaactggattctattcgaaaaaagcaatcttcgtttgctctgcaggaagtatgggatcccgttcttcacccttaacgacccggcgaccacctcggaagatctggtgaggatcatccaaggttgattacttattgcgggtgaacttcgcctccatctgcccctgctgcgtcagcttgatggtgttgtagcggtagttggtggcaccggtctgaggattgtacagtccattgtccgtagtgataagtccgtcctcgcggaggttcttcacatagtaggagacctgctgtttcttcagaccgaacttcttctcgatgtcctgattggtcacaactccgttgttcacggtcttttcgtagatgaatttcaggatgtctcttcctttcctgtcggacttagtgtttttaggagctttggtcgtaaggatcggaaggatctgctcctcaaggggcaggtcggccctgtcctgaacataatacacagttgcaccgacaaaataagctgcggaatatgccgcgaatgccattagtttggttccaccagttacattgatagtatacttgtgaggcccgcgggatttttccgcttctactgcctgagagatcttatccataacgtcctggaaatcatattcctgaaccgagacaagttccacaggagtgtttcccttgtggagatattctgctatctcttcggcactttccagatattgtccgctgtaaaacaggtacactttctcgattcccgggatgagtttgaaacctttcatgatgggttcggtgacctttcctgcggtagcaaaatggatgtgcatactgtagagtaatacagtacaaatttaatatttactgtatgaggattttgccatatcattctaggcccatctactatacatgaaagccggaaacaaccaggacttcggaatgagcatgaacgacgcagaaatctacgccctcggaaggatgtatgaattcggaattaccgtggaacaggaccacagaaaagctgccgaactctacatcgaggcggccgaaatgggaaacgaacaggcgaagaacgtgttcttcttcgacttcgaccagaaaccgaggatcaacacaaaacaggaacgtgtggcaaccataatggaagcggcacagatgggatatgttgacgcacaatactctctcgggggaaggtaccgtggaggaatagggatgaggaagagctaccccgcagccttttactggctgtcgaaggccgctgaacagggtcatgtcgaggctacctactacctcggagcgatgtacctcagaggaagagggaccgaagtggatatcggaaaagcaaaagagctcactaggaaggccgcagacctcggatatgcgccggcacagcacgagatcggaaaggtccttctcggcgaagagggcagaaagttagaagcgatcgaatggatcagacgttcctcagacaacggatatcgtatcgcacagttcgatctggggactatgcatctccagggcgacggggttgaattcgatcctattcgcggaatggaactgcttaccagttccgccaaacagagatatgcatctgcggcatacaaactcggagagatcttcgacaaaggacagtacggattcgagaaggatcccgaaaaggccatcaggtggtacaagaaggcacagaggattggatatgttggtgcggaactccgtcttgcccagatctatcagaacggcgagggggtcgagagggacctcttccagtgtatcaagtattacaagctggccgaccaacacggatggcactacgcgaacaacatgctgatggagatctttgccaactgaatagtaaacgagttaatcggaccgttgtccccgaacatagtactgttgttcgaacggtccgattattcgagaacattgttaaatactctgcaaagaggtttcgaaattacttagcgatttaaccggaaggtgaaaaatggctgaagacatactgtatttggattttagctcgaactccgagatcaacgaagagttcaattacgataagatttacaaagtaggactcagggaacagttcaagaaactcggtttccatgaagattatgactcattcgtttcccatgtcctccctcaggatgaatcgattgtaggtatttcctaccctaacttcgaaagacaccctcccaccgaggatggaaaaaacaaatggttcaacatcgcagtcaggattccactcgatggaagtaagaacaatctcgtcctcatgtgcgatctcgacgagtacactcccaagaacaaaacaatcaaacaacgttccctgaaggtgaagggtttcacactcatcgacaaatcgaccgaaacgtgcggagagatagaagtctcttgcaggatattcgcccgtcttgatttcaacgacggatggtacagcgaatacgacggacctaccaaattccctagcgatgaccagtggaacaaatccgtcctcaccatcgagttcctgaaacgtttgaacgagcagtatgttgcagaacctcatgcaaaagtcctcagcaggctggaccgctggcagaaatacctagattccaggcaagaaataatgatcaaggatcaggagatctgcttcgaatccgctgaagggaccgaagtcatcattgcttattataaagacggctgtaccgaggaggaaaggaaaaccgccgttgcccatcttaacgtcaagggcaatagtagtatctggagcacggaagatctcagcggatcggaaaaagcacctattctccatttcacccacgatttcctcaagaaggatccagaatcggacaagagttacagaaagaaattcgagagattcacaagcggacgttcgcttatcttctcaggaaagatagaatacaaaacaatcgaacgcaaggacggttcaaaagagaagataccggcatttccttcggagataaagatacaggattcgaggatctcctccaaagtcggcgaggaggagatacccaacacagccaagatcgattctctgatgaagcaatatgatcaaaggatcagagagtccgttgacgaagttgaaaaacaaaagaaggcagagatagagactcttgtcgattcgttcgtgaagaacagattgaaaacacttgaatcggagtacagggcagaggtacgcggagacttcctccccgaatgccagaaggaacttgactctctcatcgaagtgaaaaggaaagacatatcaaaagaaattgcggatgccgaggaaaggacttccgcagatgccgaagaactcgctgcagtgagaaaaaggaaatccgacctgatcgcggaattggaagaactcacatcctttgtgaaaaaaggaactgcaaagttactagctgcgaagagtgcagaggagagatccaagctttccaaggagattgctgacaagaagaaggaggtcacggacaaaacaagagagaagaacaatctggaacagaagattgtcgccctgattcagtccattccggaaaacaacaaggttctcgagacgctcaggtccaagtatgagaagattcccgaacaattctccctggatgaaatgctggaaaaggcaatggcctctacgctggcgaagttcagaaaggatagaaccgaggaatatctcaacgaatgcaggcagaacctctattccaaatatgaacagctcaaatccgccacacaggctgatctgaccgtaaaaagggacaaggagatacaggatgtcctcgacaatgagacgcatatccgtctccatgtattcttccgtttagacgtggattccagttatgaatctggttccatcctacagaacgtcaaggaaaagatgtccgacaggaagatgtacctctacatggactacagcggagaccgtgcggtcatcggccgtcacaatcaggcactgtatttcctcaaaaaaggatacgtcctgaatcccttcctcgctaccgcgctcttcaacaaatctacacagaaatgtatcgaggagttgccgatagacaaattcttcagccccagactcaacgacaggcagaaacaggccgtccgcagagcagtatcctcgaacggactgttcctgatacgtggtccacccggaaccggaaagaccgaagttatcgcagagattaccgcacaattgatcacacagggcaagaaggttctgattgccagcgagaaccacaaggcggtcgacaacgcattcgacaggctgccggagattccttccttgcgtgctgtccgtatcttcggaggatttgcggccaagaaaggcgagaagaacaaatttgcaacatccaaactgactcgtaacttctaccaggacatagctaaatgccttgatgacgagatcagaaaatcttccgcttcgacggaatatgcagctaaactggattcacttatcgaaggattcagaaaacgttgcaaggatcttgaagatctgaaagcaaaagccgattccgttttgaccgagattgaagacaaagaatcggaaatcacacgtgtcaacaagaaactcgcccgtgacatcgatgacaacagcgagtacgaatcccagatcttcgaactcaaggaagcgattaagagcatcgaaaacggagaacaggaagctttcgaaacatattgcaaggacctttctgtcaaactaaacggaaccaaactctctgtcgatgcgattcgtgcactgtatctgttcaaaaagaccgacatcaacaaagaattcctagtcatttcagaacacccggaattcttcgtattgttcaaagatagggcatccgcaaccgatgaatcgaccagaaaatccataggagtgaagattctcgagtatcagaaagaacacggcatcaatgcctacgagacccgtctcctgaagatcttccccgagggcattcctgacaaagaaactgtccttgacctcaaggaaaaggtcgaagataaagtagacttggcaatcgaggatctggagaagaagatcaaaggctgcagagcggtatgcagcgatacctcccgcaaggaacaggaactgcgctccctcgaaaaggaacttcaggaactccgcaacgacaatgctctaatcgagtacgagaatgcaagtcaagaacttgactccgacattcgcaaagtcctttccgacaacaacatcatcggagtcttcaagacccccgaggaaggaatcggtttcatcgagacagagaaaggacgtatcaagaaagcagcatcctcgggactgtccttggaactccgcgagtcctacaagaagatggcagattaccttaaggatgaatcggtcatcgagaaagacgaggaatctctgaacgagacgttactgtactacgcgaatgtcatcggcctcacttgtacaaccaaggacaacatcaagaccgatgcaggtgttgttgatctgaagagggctaaccttgatgtcgtaatcgttgacgaggtcagcaaggtctccttcctggaggtcctttatccgatcctatacggaaagaccgtcattctggtgggagacgataaacagctgcctccgacataccaatcctccgtcgacaaggatgacatgagccgttacgattccgaccttgtcaatcctgatttggagaaggagttccagcacctgttcgagacctcattcttcaaggaactgtacgattcggttccggaatgccacaagactatgctcaccacccagtaccgtatgcacccggacatcatggaagctgacaatatcttctacgacggtcagcttacttacgggggagcggaaggcaacagggaacattaccttgagatcaaaggtgtgcaaaagaagatcatcacaccgaagaaccacttggtattcatcgatgtggagggtgacgagatcaggggctattccggaggaacctccgtcatcaactacagagaggcggaggtcatcatcagtcttctgaagaagatggagtacggttgccataaggatgccaatggtcaggaactcggtggaagaacgtttaccaaagacgacgatccccgtctcagtcttggagtgatatgcggttattcggatcaggcgaagattatccgcaacaagatcaggaacgtcaaattccaggctttcaacaggaaagacgaggaacagttcatggtcgacacggttgataacttccaaggtgacgagagggacatcatcatcctgtcattggtcaggagtaatccttccaagaggttcatgaccaagttcaacaggatcaatgtcgcagtaagccgtgcaagatgccttctcgtcatcgtcggtaacgctaaagcattctccagcctgagaatagaactcgacggcaaagaggacttcgtctacagtaaaatcgttgagaccgcaaagagaagtcacggttacttcgccgcaaaggatatcataggagagtgagaggaatgtctgaaaaccgtatcaacatcaaagtgcccgtactctgcctaaaagtcagcggagagtacagcagattcaagaaaccggcaggattggagaacctggttcttacagcaatcggtacccccgcactgagttccgacacctggggagaattcctcggcagactcgcaatccccgaaaggatggggcccctgttcgaacaggtcgttagggaactgtacagtaacggagtgatagactcggatgatttcgacctcgaccacaggatagattccctcgaattcaccgataccggaagggatctcttcgagatgggtcgcatcaaacaggaccccaaagaatattctgaggagatctatttcgcaccatatacgaaatattcagacccgaaatactacttcaatctcgagttcgactcaccggaaggtttcgaccagagcagattcggagatatcacattcgatctcgacaatgttaagtggttccttgccgaaaataaaaacagatcaaggcagacaaagatgatgaaatcctatcaatccgcttggatgacgagccccaggtgctgtgcaggaagaaacacatcgacctgcagttcgacgaaacctctggagatttcgcattcgataccgatctggatcccaacttcataaagggatactttactgccgatgacttcctcggtaaaaatgaggaactctccgcattgcctaaaggaatgagctctcccgagtacactgtcattcctgaggagtgggaatcttacagataccagctgccgaaggacttctccttcaaaggcaaactcagagcatttaatcccaagaactgcaaggtcgaggatgccacaccgatggattcgctaaggtacagcttcgtggacgtcctcggaccggaactgggcagaggatacatcttcatcaggaagaaagcaacggtgctgggtctgaaaggcgagagcgagttcggaatgcttgtttccagacctctgtcgaaatcggagatttctgaaatcctgagccatgtgatatctactttcgattccgcatcctatgaagaactgaattccatcctttccctgaaggaaatctcctccgaggaatcctatgaatccaagtggatcgtcaatcaccttgagaaaacaggagatctcattgcatcattaaacagtctgaacaaagacaagaagaaatggatgcagaaagagaccgcacttttggaagaggtgttctgcagaagaaacctgaacacagaggaaaccgtcaagattatctcgggactaggtatgaaactaccctgtacgaaacttggtccccaccttgcaaccggagataaccagaaggatcttgagattctcgacagactcctcacgatctccaacagcaaaggaattctcgtggcaggaatgaacctaaagaacgctttggtctcagcggttctttccactgactacggagatttcgtttccacggagctgattgcacttaatgctttgtcgaaatcctttggcagactgagggctattttcgccataaaatcggctactgaatacgacctctcgaaagtcgaggaatcggaattggattctatctctgcggaatacaactctgccaacaaatccctatcagttgtgtctcccttgcttgcaggagcggacaacctctccgaactccagagatacatggaccttatccagaatctagccgagatctacagcaaagatgttcctctcgaaaggctcaatggataccagttcggagtcggagtaaggagaaagatggaatctctgctacgcagcaaactgcatggaacggataaactcgatgatctcattgagcgtgcagccaaaaacaaagtaattaccgacattgaaaaagagacattccacaaaatcagaaaattcggcaacggatgtgctcatacggaggatttccctgccctcgatgcaaaacagaagaaagcttgggttgatgcagtaaacaacttagaaaaacgtcttaaaaaaggatgtaaagcatgaacgacttcaaaacaatggcaaaatccggcaaggattttgccaccatcatttatgatcatgtttccgaggatgtcgaaaacattgtggccgaggtgtttacagacggtatgaagatacagaccatcctatgtgatgagtccgatacctcgatcaccatccaaccccttgcaaaaggaaactacacctacacaataacccagattgcagggggtaccgtatcgaaatcagaaggagaattctccatcgtcagggacaatgaaaatgacgagttattcagagcaatgatggataagctcgaagaattcggtaagcaaatcaaaaagctctacgacaaggtagatgaacttgcaaagaagaccggttccgacaacactgaagtagagaatcaaaagaaatatgttgaaaatgcaacaaaactgcaaattctgaatgctaagctgaatgcctgtgaatccgaaatagttgcattgcaaaatgaacaattgcatgaggacattgatgggccctctcttggtcaaatgaagaaggatcttgagggccttttccgggctgaacgtccgtgaaggaggccctctcttggtcaaatgaagaaggatcttgagaggatgcaatatcagcagcagacccaggctatgacagcaaagaaagaagaggcacttgtaaaggccattggagaactatccaaacatattaaagaacgtgaaatggaactaacaacaagaacaagaaccactgagaaattgaaacaattgttctcggaaaaaagaaagattgcttcacgagatcaagattaccagtgaaaattgactatgtaattccattgactcgaatcgagaagaacgataacatgaatgacttcaaaaccaaagccaaaaccggaaaagacttcgcaatcatcctcttcgacaaggtagcagaggatgttgagaacacaataatcgagatttcgctcgatggcatgtccctgaaaacctatctgtgtgaagattccgacacatctctgactattcaacctctgtcggaaggaggatatacctacaaaatcacccaattagtgaatggaaatgcctatgtttcggaaggtgattttgccattgtcagcgacatacaatctggatcagagaccagacacatccccttctatgagaaattcgataagtctgattactacgaactggtgaaattcatacttcccaaatgggtaactgaaggcgaggaaatacacctcgcttggaaattagagccagaattattcgaaaacattcacctcggaacgagaaaatgcaaagagtcgatgaaattgatccgtaatgaatgtctcacacctacaacaagtgatgtttcattcagtatccaagaattttctgatgcgatgatctaccttgaattcatgctgaaaaacggtcagatttttgggattaagattaatggagttatgtctgaagtacataatatcccttatgatcgtaatgctcccaaaagttattccatcatgtggagtcaacactgggaagattgcggtgaaactcagagagttgaggtaaccaacgttgtggatgtgcaagacccaagatcaaactatagatcaaactacattcctcatttgtgattatagctttagctaaatgggccctaatcattaaaaattcgaacgtcgggcaatcaagcggtctggccctcatccccggacttctccggaagctccggggacccttcttccgacttctccgaagtagcaagtgcttcggacatcgggggaatattgctgcattccttcagcagttcgacacttccctcagcttgacttggacagttgagttttcgtgttgagacgtttttgccgttaaaggccgaatgcaaagttcaacaagaagcagagccttgaagccgttcatggctaaacaaacgacattcaaggcagcggatgctatggccggatggaatatatcgttatccttcggcatcatggaactcgtacgaaaagggttccgcagattgcatctttatgactttctcaacgggttcaaggaaaaaggcgtaccgctgggatatgttgtggagctgatgtgtatacatcaactgagcgggggagcatacatgaacaaatgcgaaacggattcgtcttctcctttggcaagggaggagctctgccacggatacgtgatctcgagaaagaccatggaacgggctttggatctgttggacacgtatttcgaggatacgatctctttcctttgggggcggctgaagggaatctatcccgaccttgatacggatgtatatgtggacggatcccatatagtcagatacgggtcgaaaggggagaacaccgccgccggtgaaggcggcggaaccatacagttgcaggatcagttcgtggtcgctcagttggcaaaatcgggactgccgatatccatagaactgtatccgggcaattggaacgatccgccgcagtatcaggatttcattcctcagctcatgttcatgctgaaggaaggatccaggataatcatggacgcgggagggtcggacaaagctctgttggacgagatcaaggaaagcgatatgagatatcgcaccagagtgaagatgaacaagtccgatgagcagatgatcgacgaatgtcccgataggatgcagtatctggacagaggtatgatcgttatcgcccacagattcgaatcatcgggcaagacgaactatctgttcttctccgccgacagatatgtgatgggacaggctgcagccgagagaagggcggctaaactcgcccagcagatgactgatgccagagacatcatgaaggaaccgaagataggcaaactggtgacggtgaagaggaatcctttctacgatgtaatgatcaaatccttcgagatacagatgaaactcaatccgtggttggatggagacatacttctggctgccaaggaggaagcaggggacaggtgcggttggttcaaacttcagtcatcggaatggatggaaccctcggaagcgttggacatatacaggcacagggtgggcatcgaacacctcatttcatcgataaagagcgttgtcaatctgaaaccgctacgggtgtggagcagatcctccgtcagaggatctctgatgttggcattgatcgcccagttgcagatctctgtgctcagatacgatatggaaccggatatcatcgagaagatggtggatgggaagaggacacgtatcgaacataaaccgtcggcaaagacgattatcgagaatctgattcattggacagtaacgctcattccacgtgatgggtggaatatagagcgcatatttagcaacgaaactgacctgacaagagagatttctgagattttgaagcgttatcgagggtgtttttacaggcattcagcccgtttatggcgcatataacattaactgtccaatgaatctgttttccaaatttttcaaaattactggccatggtcattggacagaagatttcgcgaggtaaaatttccgaaattgtatctattgtgcaagatcaactgtccaagtcaagatcataacgaaccttttcagtttcaattcctgctctacagaaagactgatgtctccatcagcatgtactattttatcaagaatgctgctgaattcggcttccgcacgttcattcagatacttctctgtatactcattataataaccgactttcgaataggccgattctatcggacagtctttacgataggtgccatcactgcgacgatacatgttgacggaactaccgaaattcttcaggatgaatctcggcacataatgactgttcacaggcaaaggaatccctttgcccatgacattgtcttcccccatacttactatttctccgaaatggaaggttcgatcggttcaactgttcagcacctgctctttgacggggatggccttttcgtatccggatttgataagatcgtcgagacattctatgatcgcatcactcacgctgaaggaacacggaatggcagccgaagcggaggagatgaggaacagaatctactcatgtggaagctacgcggaagccttggacatcatttccgaatatgtggaaatcgtttgatgagcctctgcggagtaatgtccgcagaggctatccgttcaatcatagcagatgatctcgtcttcgataatatggatgatttccgcgggaaccgtcgacatgtcgagaagataggccacattgagacggggattgaatattcctatcttagacagacctttgtattcgggatttccggacctgtgtgccatgatgtaatacatcgcaagctgcagagtgtatctggaggtgggttcggaagagattactttgaagtcccagatggtatcagcggtacagaaatcaccgtctcccgttctgactgtttcagtgtatccgtctggaccgaacgtgggaccttcgaccgtaaccggcccgtatttctcgaaaaacgcatgggcacggatgatcatgatgcggatgctctcgcaggtggattcatcggcaactgcattatccggatcgcccagtgtggttcctgcacgatatacctgatcataccatacaagtctgcatgcattcttgatggattcgtcatcggttccgcgtatcttcgaaagatatccttccgcacgtttggtctcgttgatcttggcagcaccgagcaggcttatgccgaacgcctctcttggagaagctccctgttcgagacggctcaggtagtcgacgaccattccgacggtcggtgcctttacggactccattccgagttcgagaccgtcgtcgaactgtatcctttccatcgacttcggttttatgaaaccgcctctgggctgtttgatctgacttatcctcttggttacgctgacacctttgtcgcctttgtacctctgcgatttgggtttgaactcggtaacaggcacttcgggaggtagttccggaagaggtgcgggattctctgcctcccgtttcctgcgttcggcatcctccgcagagaatgatttcaccaatgcctggattttatcgatctccgccacaggattcttccaccagttgggactccagatacggtagatcctccatccgcgtgattcgaggtagttctgtctgtggaaatccctttccctggcggatttggaactgtgatatagctttccatcgcattcgattccgaggatgtacctgccttccgagcggacggcaagatctatcctgtatccgccgactccgacctgcgtatccacatcgaggcctctttcgagaagcatatcataaacctggttctcgaagtcgctgtcgaaatgaattgcacttccgggattgagctcgtctccgaaggaatgcaggatactgcgttcggtctccatgtccctggcgcttaccgcatgggcatactgcagatacttcttgaaatacttcggacccttgttcttaacgtcactgacatcgaggtcggatggatcgaaggaggtgactatgtagatcttcttcttggctctggagacggcaacattgagcctgttctctccgccttcgttgttgaggctgccgaagaagcgcatcatgcgtccgttctcgttcttggcataggtggtggagaagataatgacatcacgttcgtctccctgcacattctcgatgttcttcacaaacagtccggtatcctctccccggtccttgcggacgagctctttctgcacacaggcattgaactggggatcggcacggcagagttcatcgatcctgtcatcgatgagatcacgctggttggtgttgaaagtgatgattccgacggattcgttctcgcgtctctgcaggaagaatgtacggagaagttcggccacgcgctgagcttccatgggactggtacggttggtccacacggaatcataggtcttgatgacttcgattgggggttcctccgggacctccgtattgggtgccacatacagtctgcccttgtagtaggcgtagttggagaatgcgatgagttcctcgtatttcgaacggtaatggaagttgaggatcacacagggatatctgaaccttgcaaggtcaaggagactctcctcttccagagccgcgttgccggcaacggtatcgtcatcctcgtcatcgtctgaattgtcggtcatccttccctttccgacggagttgggcctcagctggttctcatcacccacgataacgaccttcttcgcacggagaatcgcaggaataccgttctcgacgaacatctgggatgcctcatcgaacacagctaggtcgaacctgcccttctgcagggggatgatttcggacacgacctcgggagtcatcatccagattttcaccgaatcgaagagctccctgctgtaggtcttgacgaacttgttgaccgacatcttcctcttggtctcgatcttgcgtttgatttcctggccgcgtttgctttgtccgagcttgctgagctcgatggatagaacggcctgcatctgtctgcgggatatctccttcttctgaccgatgagttccttcagttttgcgatgtatccgtcaaaggaaccgatgctgcttaggacattcctgtgtttggattcgaaactgtcaagatgccagtcaaggaccgaatcgaagagttcatcgttggtctcggtgtcggcactgccgatcatcttcatgctttcgaagtattccctctccgaagacgtgagtttcgagtatactgtgttggtcttatcgtagtcctcgtacagacttctgtcgcagatgagcccatcggtgtttccagccattatcctgtccgagatactttcgatattgccggtgaaattcctccttaccgtctccgcgacttttttcttcatctttcccttgccgaggagtttaccgaagaatcccttgtggttgaactcggtgacatcctttagcagtgcatcgagctcgcataccatctggtcgaattccgcactgctgagggaggggcggtagtccttcagtgcgggacacttgtcagcacattccccgttgagtgcgaggtttccgacaagctggctgtttccgaaggtcgaatgggcatcctccagttcgttgtacttcattccgaggacctttcccgacttctggagttttgccaggttctccatctccctctggcccctgtcggaaccggaacggttcagatggtagagcctgtagggttcgataccgaacgaatcgggagtgtaaagagtggatgcgatgttctgcagctccctcacggtctcatcgatcttacgggagatgttttccagctgttccgtggaaggtgagaccacgctgttgtagtcaaccatgcgctgaagctgggaatagaacagttccttgcttcccacatcatcgaggatcatagcatactgggacagatttccgagacgggaatagacgacatcaagtgcggtcttcttctcggataccatgagtacggtttttccgctacaggcgaaatccgcgatcagacttgcgatcatctgggattttcctgttcccggaggtcccttgacaaccagtttatctgattttttgatggcggaaataacattctcctgggagctgtttagatcattgatgtaaatgatctccttctctgaaatctggagatccttgtcgggagcatcgatctcggtttccccgtcataggaataatcgactttttcctcctcacggtatgtgtcgagcagttcctccaccaggtcattgatctcgtttttatccagcatctgttgataatcgaactggatggtgctggagaactgcgagaagtttccgagtaccgctgcgttatcaagatagagttgaccggattcataagcggggaactcgttggccagatagttttggaacctgtgaagttcttcccccgaatcccggattactatgccctgtcccttgaagaactccagcacatcgcggatgaaggtctctttctggatatccccgacctctccgagagaagtgtcataagcaagtccgttgaatttgcaatgagccataatcagagttgtgttgtacagaatgtcacggtctgtatcctgggatattgaaatccttgaagcatcgcgtttcgccgacacggggataaacacaaggggtgcgcgtacattgaaatcctctccggtaagccttcccttgatgaaaggatatgcaaggtacagattgttctgacccttgtcacgacgttcgttctcgttctcacggatcaatgtgttgaacttggaatgggtattgcgttcgctggtaagatcggccgcaggatggtaaagatcggcaacaaccatctccttcctgtcgctccagatgatctcacggggatcagccctaccgtccaggaaaatatccaggccctttttgttctggcatttggcgaaatacagcagacggttcctcttgttgatgctgacaagtttgttctccagcctttcaagggtctccctgagatccgcatccatgggaacggctttcatggatgattcggtctcggtctgctggatgactttgagaaaacgctgtgcatagttatccatgaaggtctttcccactccgggaatgctcatgaactcatccaaggtctggggacgtgttgccgcgatatcgcggagagtatcgtcactgcataccgaaggcacccttccgttactgtaacggccctctttcttcaattcctcacggagcctgtataatgcccggtaggtggtttccgtgccgtccatatttccggatggatttcactacatttattctatctggcataacaaaaaccgatttgttaaaaagcagtctcttgctaaactttagttgcaaatatcaaaagaaggcaagagaccatgaaattcattggaatcgatgtacataaaagaatctataccgcccgcattctggacgacagcgaaaagctcgtcggagagctgaatgatattccgaccgctttgtaagggttgcagagacttacaaaaccataccctccggaagactgttctatcgttttcgagaacctgggcagggctcatttcgttaaacgtgtactgaacgacatgggatattcactcgaagcggcccataccggacacggggcgatgatttcgccgaatccgccgcatacaaccgcaagtatggaaacgatgacgacgaagacgacaataacgaagaagtccacgatgacgacgaagccgacgatgacaataaaggcggcgatgaggacagcatcgaagatgatgacagtattgacgagagcgacgatcggatcgaagatccccgtcatcacccggtgaaggtcgatctcagaaaaccaattcttatcgagcatctcgacatcgatctcatgtcagggaaaggaccgatcctttccgagagaggcggcatcaggcacggagagctggtggagttcaccgtcaggtgcccgaaccatgatatcgcattcgatctcatccagaccattaacgagagatacttccccgacgaggatcaggatccctctgaggcatcctcatgaccaacaggggagtcaacaagtggatcgggaacaggaaagagacatacgaagcaaccaattcagaatacaggaagaacttggaatcctacgaatacttcgtcatccccacaaggtatccaaagcagaccagggtcaatggtgactatcgcaattggaaatcaagcaaacccatcccgaggggatgggtggacatcagcaggatcacaggaccagtagtgcgcaaactcgacgacggttacatcaggcaaagactagctctcagtaaatcgaacatcgcatacaatcagcattacatcgagaggatcctcaacaaccccaagacccctaaatgcaaccgcgaagtggccatcaagttcgtaaaggaccatccggattacttcataccgagacccacagacacaccattcgaggacctcaacaggcacaattccataattaatggcgacaatccggacaggaagttcatatcaaggttcatctgaccgacaatctcaatcgaatccatctgtaagaaggcaacgcatcacagcatcatcatggggcgagggcatccgcccctttcaattgcactgttcatcaagctattgcctgtcgtgctctagaaccggttgacgattctttcgggtcatttacgatgatatagttttataatgctacctggtttcttatagtaggtgcgattactgtccgattttggacgtgaggtaccgtaaagagatgattattatggacaaggagcagcagaggctatccatactcgaatattacgtgggtgggaaactctacaatcctgaacacagtaaggcaatcatcaagcaacttaagaatcagggctatctcagatgcgggattacttccgacatcaaggagactatcaagacaactgataatggtctgctatatttggatctggctggaatcgatgtcggagccccgaccgtcgtaggcggaaggatctgcaaaaccaaaagggcggccctttgatcttttatggatgggtgccccatctcaatccgggactgggtgtctccgtccccaatcccctcagtcgtatcgagcaatcgatggatagtgtgaacgtcatcgttgcgatatgtcaggcattctacgtatggtgatcgatagtcaatacgccattcggttccaaggtccactatcaatgcctttaattcggtccatagtatacagtaatccatggatgagatggccataatcaacagcaacgtcggttctgtcgaagcggagggtttccacattccggaggaaacgaagctcctcgccctcagatgtctcaaaggcgagatgtccttcgatgatgctataagtcagatcatctccgaatacagatcatgactatcgaaccatacttccacgtgaaggatgacacctattgttatccggattccaatgtacttcgcaaccttttgggcatcatcgattacgatgaacttgtttctgctgaaggtcggctgaccatgatggccatgacgcagttggatgtcgatccggtcaaaggatgtttcgatacggagcatctcaggaccatccatcgttgtatcttcaaggacatctatgactgggcaggcgagttcagaacggtggagatttcaaaggggataccgttctgctactgtgctaacatccaatcccagttggattccatattcgcccaattgcacaaggagaatctcctcaaagacatcactgacaaggatcaatacgtctccagaatcgcattctatttcggggagctcaacgcagtccaagcccaaaatcggtgcgagatttgaaaaacctctacgaaacctattaacaataccgtgagaagtcgtaaaagaagttacgtttttcgtgggagattcgaactcaatagtgcggacgtacctccgcgccatgagggtagccagaaggtagaaatggcgccgagagagagattcgaactcccgaggtcaaggaccagtggttttcgagaccaccgccataccgggcttggctatctcggctcggacagaccaaccattttcccatatttataattcatagtcccttcttttctatcaagttttaaatgataaaggtcgattgagccgtcatgacggatactgtatccgagataagggacgcaaagactgcggccctggagatggccgccctggacacgggcgtcaagaactctgcgttgaatgccatggcggaggctctggaagccaaccgttccgttatattggaggcaaatgcggaggacgtacgcgactccgaggggaaggtcccggcggagatcctaagcaggctcagactcagcgactccaagatctcggacatggtgttcagtctgaaggacgtggccgccctacccgaccctgtgggggagaccatgtccgccaccgagctggacgagaacctggtcctttatcaggtgagatgcccaatcggcatgataggcgtgatattcgaatcccgtccggatgtcgtcccccagatcatgtccctgtgtctcaagagcggtaacagcatcgcattcaagggcggttccgaggcgagacgctccaacagggttctcttcgatatcctgagggatgcggcggtatcggccggagtccccggcaaggcgttcgtcctcatggagaccagggaggacatagccgagatactgaaactggacagttacatcgacctgttgatccccaggggatcctattcgttcgttcgttacatacaggagaacacaaggatcccggtgctgggtcattcggcgggcatatgccatgtttatgtggatgccgatgcggacatggatactgcgttcaaggtctccctcgactccaagatacagtaccctgcggcctgtaatgcggcagagaagctcctggtcaactccaaggtcgccagatatttccttccccgtatggccgacctgttcgcggccaacggtgtggagatgagggtggatgggagatgcaaaccccacatgctcggattcgatgtgaaggacgcctccgatgacgattggtatgccgagtatgattcccgcataatcgccataaaagtggtcgattccgccgacgaggcgatagatttcatcaactcccacggttcgcatcacacagattgcataatctcggagaacgaggagaggcagagggatttcgtcaggagggtggattccgccgacgtattcataaacgcatccaccaggtttgccgacgggtaccgtttcggcaagggggcggaggtcggcatctccacgggcaaggtgcacgcacgcgggcccatgggcatggatggtctgatgatctacaagtacgtccttgtcgggaaagggcagaccgtcaaggagtattccggtcccgatgcgaagaagtatacgcacagacatgtagatgcggaatacaggctgtgatgtgccatggacaggaaggaactgctgggagacgtcgagagggtggtaatcaaagtaggtacctcgtcgataaccatgggcggttccgtaccgtcctccgacttcatggacggtgtcgcccgtcagataagcaatctcaagggccaggggaaggaggtcctgatcgtgtcttccggggccataggcataggtctcaaggcgatgaacgcacggccgaagcctaacgaggtccccataaagcaggccgccgcctcggtggggcagggtatcctgatgcagaagtggaacgatgcgttccagagatacggactcaacgtggcccagatcctcatcacgatggacgactactcggacagggacacggtgctcaacctcaacaacaccatctccacacttctgaagtacggcgtgataccgatcttcaacgaaaacgatgccatatcggtcaaggagatcggggccgtattcggagacaacgacactctgtccgcagtaatagccagcagggcggatgcagacctgcttgtcatattgtccgacgtcgctgggctctacgacggcaatcccaaggacaacccggatgccaaactgatctccgtagtagacggtcttagcgaggatataataaaagtcgcagggggacccgggaccaagatgggtaccgggggcatgaggacgaaactcaatgcggccaagatatgcaacgacgcaggctgcaggatgataatcgccagcagtgccgagccggatataatcctcaggaccgtcggcggagaggacatcggaacggtgttcctttcggacaacgtcatatcgaagaagaggagatggataaaggcggcctgtcccaacggttccctgttcgtggacgacggtgcaggaaaggccatactggcacatcgttcgttgctgcccgtgggggtcaagtatgccacggggaccttcgaggcgggggccatagtggatatcgtgtgcgggggcaacatcattgccagaggtgtggtcgattacgggtccgaggagatcaaccgcatacgcgggatgcgttcggatgcggccaaggccgccctcaatggggtcatgccccacaaagacgtcgtacgcagcgagaatctggcgatattgccgtaaaatcatgtttttacataccggtggacccggtttcatgcatcccgattatcgaaaatcgggatgataaatataattgcataaattagatttcaatcggtatgcccgaattgaaccttgacaatactgatgagcgtagaagacatttggacatacctcttatgaaattggatgagaagtacactctgacgatattgtacgtccttaggaacggcccgatacagaagacagatctcatcaacatcgttgccagttcttcagacacggtgaagaagagagtagaccatcttgtggaggagggattggtccaggaggtgcgtgagaatcagagaccctttaggaagatggtccggctcacggagaaaggcaaacgcatatcctgttgggtcgtatagttgaactccgatctctgaacgaggtcgcccgggtcatcgcccgggtggccaatcattgttttcttatgggatggtgtaggcatgtggatttggaaacatgtcttcctaccgagcgatcgccgatcatcgtatccggtcgaatactccgtcgaggatcgtaataaacatctcaaaaccatagattgtggcaaaaatccctgcggattgcaaggatggtgggcccggccagatttgaactggcgaccttcacaatgtcaatgtgacgtcataacccctagaccacgagcccagtattcctccgtaacaactggtcattattatactttatgggtcctttataaagggtggccggcgcagggcatcccaatcacaagggtttattatgacctaggatgtcagcggtccgatgataacgctcggtatcgagggaacggcccatactttgggggtaggcgtggtcgattcggagaggaaggtcctctccaacgtgatcgacatgtataggcctcctcagggaggtcttcaccccagggaggcggccaaccaccatgccgaggtggtggcgggggatatagagaaggccgtttccgatgcagggatatcgttgaaggatgtagacctcgtcgcattctccatgggtcccggcctcggcccttgtctccgtgtggcagggaccgccgcccgcgctctcgcgctttccctggatgttccgataatcggcgtcaaccattgcatctcccacatagagatcggtaatgcgatgaccgggtgcaccgatccgtgcctcctatatgcatccggcgggaacacacaggtcatagcgtattccgacagcaggtataggatattcggagagacccaggatgtcggaataggcaatatgctggacaagttgggccgtgacctcggtctcggattctatgccggtccgaccatcgagaagctggctttagacggggataagttgctggatcttccgtattccgtcaaaggcatggacatagccttctccgggattctgaccgcggccatggcgtacaaggaaaagggttgccgtttggaggatatatgtttctccgttcaggagaccgccttctcgatgctcacggaggtcacggaaagggccatggcccatgtgggtaagtccgaagtgctcttagggggcggtgtagcgcagaatggccgcctcagggagatggtgggcgagatggcgaaggaaaggggcggaaggatgttcgttcccgaccgtcagttctgcagggacaacggcgccatgatcgcttggctcgggaacctcatgtactcgtccggtgtgaggatggatgtgggagacacagaggtcaggcagaggttcagaacggatgaggtctctgttacttggcgtaagtaaaataatattttactattaggaggcagacttcccctgcttctgcctgcctactatggcgtctacgtttttcaggaactcgtctctcttctcggacttgaaggaccctccggccgctatcttatgtcctcctccctcccctccgacggacgcacatccttctttcatcgcttcggcgaggtcgataccttttgccaattgggagaatgtgcctctggacgatacgttggcgttctcgtcggatgcatttatgccgatggtgggtttgtcggggtcccctatgtaactcatgacggtgccgcagagcattccggtgaatcccgtggatgaactgtcgaaccactggatgttctccatctggatgatgctctcgccattatcaaggactttgatcccctccatgagctgtttccgggaagtgttatcgagttccttggcctgtttcagacagtcggggtcccccatccctgcacctatccctaccgacggcatgttctggcgtccgcaggagttcaggaaggacgagaggctctccgcatcggtgttccaccccgggagatagtatttggtcctggccagttcctccagtttttcacgcgatacgccttgctggatgagtcttatggcgatcagggaagacagtctgatgctctcctcctcggtcaggtccacatagtccctgtcctccggaacgcccgcatccttgaggagtctggatatcccttccctgtttccgctgaccccgcggatatacgggtccgtggagatgagcagttcgtcatacagccttccaacggggatgagcgatcccggcatcggttttataagtcctctgtcgacggccccttcgaagacgaaggtgttgaatccgctcatgccgttgaggtgctgccggtctccggctattcccgccatggcgagaggtgccaggtcccagtttctctcgtccatcgcaatggcgaagaggaatgccatggtcgcaccgcatcctgatgtcatcccgtcgactccgaacatgtgggggttggcgtaacaaaccttctccgaatcccctctgagtgtgtggtggtcgaggacgatgacgtcgcaggtcatcttttcgaaacggtctatgtacgatgcacctaggtccgttacgatgacgcattccgacggagtgctctcgatgatctgcatgaattcatctatcagggtcgggaatatggtgatcctgtactccttccctgcacgatggagggcctttccgacgatggatgcggccgttatgccgtcggcgtcgtaatgggaatagacttggataaaattgtgaccgcggacgatatccgcggcttttgaaagaatggaaagtagttttgatggaaggtcggaatcgaccatggagctcacttaagcatcagttctgcgttagcgagagagtacttccacgtcttgggaaggacaccggtctccttgtagtagcgctcgagcctcctgatcttcgcctcgatcagagcgagacccctcttgtttgcaacatccttggggttctgcttgatgtggttgttcaggttgatcgcacggaccatgaggttggtgaggtcgtcgggaagctctcccttgacgttcctgtctgccatgatctcggtgacggtcttgcccgtagcgagctttacgttgggtacggcgtactggtccctgaggatcattccgatcatggccggagtgactccgtcctttgcgaacttctctacaaggtcctctatttcggtggctttaagaggtacccagtcggggttctcggtgatcatggggcgcttggagcaagcctttccctttcttctagtatgcattcttgccataatgaatcactcatcttggcggcgaggcttagtctccttatcgggacacagtatttaaaagatattataacaaataatttgttattgatttatattattatgagacgtcggcgtcgtcgatcacgcctttggcccaaggtacggtgtccatgtattcgtcgcgtgggaacgagagctcgtccggcagttctgcaaacagtcttacggtcatctcgtggtcggcggatatgcggtctccgaggatgcctgcacatacgcggcaatgaccgaggtcgcggacctctttgatgtccacggtccagccggattcctcttcgaactccctcttcgccccttcgatgcgggtctcccccgtcttcacatgtcctccgggcatctcccacccttttctcttagggttccacaccatcaggaagagtccgtccttgaatgcgatggtgtatatcgtatcgtcggtatccccgttcatgccttttccaccactatcatctcgtgggagtcctcgaacggttccaggctgcgggcgtccaatatcctcatccccctttccttcagtctctcctcggcccgtctgaagacggctttgggtgcttccgcgacatcttcggagcgggccttgaccgcgaccatgccgtatctcgccccgaatacctccatgttgtcggcgaggatgtccgcctggttcttctgggccacgtcctcatagaccacgtcggcggaacctacgacgaactggtactccgatggtttggtggcatctgcgaggataggcatcatgttcggtctgggggagcagttccccaccagctccctgaacatcctcggggcgaactccacacagtacaccttcccttcggatgccatgtccgacacgtgggagggcgtggtaccgctggacgcccccaggtagaggacgttgctgcatttccctatgggcaggaccttccccccgttcgctatgtatgcggcgagtttgctcctgttggggttccattccctgtactcctttccgtcgaccacgggcgtcctctccccgtacacgcggtgtccgggggccgcggatatggtgtagatgtgccttccttcggagaataccgtgccgttcgagaattccaggggctgcatgggtcctccgatgcatgggaggtataaaaacaagggagcatggacaaccttaaaagtcaccggcacggtagtcgtggtatgacggatatgttggacatcctccgggatatcgccgatgcggtcgtgaaggccgtcggtctgatccccggtccggaattgggtaaggacatagagatgggggcggacgggacccccacctcggaagtggataaagtcgcggagaacacggtcctcgactacatcgtccggaacaacgtccccctgaacgtcctcagcgaggagataggatatgtggacaacgggttcgaggacaccctcgtgttggatcccatagatggtacgtccaacgccatcgcaggggttcccatgtacaccgtatccatggccgtcgggaagagccgtctttcggacgtccgttacgcgtatctccgcaacgtcatgaccggcgagtccatgtgggccgagaaaggaaagggggcctacaaggacggcaggaggatgcatgtccggaaactcgatgagagggacctcttcatgatgatctatctgggcaacggcgcggacccgtcggctttcgagttggccaagcgggtcaagtcgtcccgttcctacggctgcgcctcgctggagatggaactggtcgcggaaggtcaggcggacgggttctacatgaactccgagaggtatgcgcgcgccatcagggtggtggatatcgcagccagctatcttctcctcatggaggcgggcggccacatatacgatctgaagggggaggagatggatatgccgttcaacctggaatccaggtcgaacttcctcgcatgtgcggatccggccctgttcgatttcgtcatgaaaagacgtgccaaaagcatgggcgacggtccggtgttcggtctggtggccaatccgaacgtccccaatgtgaggaagtatgcggaaagggtagtcagtgctctcgaaggagagaaaataatttttgacaaatctgcagggaacatcctcggaaagccgggtatggagatctgcgacatgtgggtggacatcatggtgacgatcggaggggatgggaccatcctccgcactctgatgaacaacagcgcccccgtggtcggcatcaatgccggaggtgtcggtttccttgccgagatcagtgtcgacgacatcgaggaagggatggcgagactccgcagaggggaatacacagtcgacgaacggttcaagctcgattcctcttccgagggggagatgtatgagacggccgtcaacgaggcggtggtccatacggattccgtcgccaagatccgtcagttcaaggtatatgtggacgacaagctcgccacggaggtgagggcggacggcataatcgtctccacatccaccggttccaccggatatgccatgagtctcggcgcccccctcatagatccgaaggtcaacgcattcgtcatcgtaccgatggccgcctataagttcgcctcgaggccgttcgtcgtgccgtccgattccaaagtgacggtggaatgcgttctggacaagggatgtctcctggttatcgacggtcaggccgagcaccccatagagggcggggcgaaggtggatttcgtgagatccgccgagaaagctaggttcatcacgttccgtcaggatttctactcccgtgtcaggaacaaactggtgaatgcgatatgaacaggataaggggcgtgagtatcgatttcatcgactccctcaacgagtcggcgaaatccacctaccccgacgagttcatatgcctccatcgggaacatgatggggtcatagatgaattggtgatgcttccggggacgatattcggggattcgcacagtgtgatattcgattggatggatccggtagatttccacaggagcgggtcggcccattcccaccccgggtattccaacgaggcctccgacgacgacaaggatgtcttcgggagtatgggcgggatccatttcatcacctgccagccctatgaccggcacagctggagggcatacaactccgcaggggaaccgatccatctggatatactctatgcggacggcaccgtggcggatgtctgatcactcgcacgactttattatgtcggtcgcctggtcgagcatcgacaccaggtagaccttgtcttgggattccgcatttatcctgagggacttagggtcgtcggaatcctgattgatgaagtatatcccgttcttcatgacgactttccatccgtcgccgatggagatctcccttatgtcgtagtccgtgatcttctctatgaacctccgaccgaacatctcgaggttaccggagaacttcaccttggcactcatgttgtagtatgacgggagttcttcgaggatgttccttatgctcctctgtcccgcaaggcaggatatgatggccgaggcgtagaccgcatccggacaaagggatctcttggggaagatgaacgtcccgtcggtcatgcctgcgaaatcggcgttgttgtccttgacggcggtcgtcacggcctccagcgagttatccaccctgatgacccttctgttctcctcctcccccggctctctgtcgtagtcgagggcaggtgcccagaacgcatcctcgaccacctcgggcgatccgaacggtatcaccgccaccctcgggcggatatatctgagcataagtgccagcagtctttctcccgtgacgaatttcccgctttcgtccatcagggccatctttgtgccgtcaccgttgtaggccaatcctatgcttccggtacttgcgttgacgaagtcggatatgttggcgaggtccgctttgccgatcccgggggagcggggaggtcttttctcacctatgtgtgcgttgagactgattatgtccgcccccgtctcggagagggcgcggggtgcgcagagggaggtgcttccgcatccgcagtccagaatggcgaatccgccgcttttcaacccctcctccgtcagtccatggatgtatgtctcattggcggaatcgtcgacggagatctgcccgatgccgtcgtatgacgggaggttcgaatcctcaccgtccatgatctccctcatcgattctgcggagatgcgcgatccgtcgggatagtatgcggtgatgccgctgacggttccataactgtccgggctccctatgcagactatgcaatcgcacatgccgccgtatgcacagcatatgacgggggtggcggttatccccacatcaatcacatgtgcgccggcggcggttatcccggattcgagggagttgcgtatcatggggctgcttggagatgtgtccatgccgaccgctatggtcttgaaaacagaacccagacggagtccgacggtctgagccttctccggagtcatgtcggttccgttcaatgcggtatggtatccgctctctccgccttccatgatacatccatgggtggtttgatttaaggtttttcggctgtagcggaccagtggatgaggccatacatcgatatcggagtcgtatgtgggaaaatgatggatgtgccccatatcctggatggaggggagacccgtatcaagtttacatttatatgacttatcaattgaaagagatggatgggttatgcctcggtccgttttttcaaccgcatgggaaaccccagactgtaattttttacgacaaaatgtgccagttatctattattttgaaacagaaaaacatgtgccagcaataaatcttaaatataaacgatttggattatgtttttggccggggttccggcaagtgggatacacatggcaatgcagaaaattgcgttcgagaaggcgaagaacatcgccaagatcaaggggctcaagcccggaaaggtcaagggaacgtccggggtccagttcaccaagggaaccaacaacaggctcgacgtcatcacatgggatgagttcgaggagatcctcgccgagaggaaactcgcgatctacgagtctggtggctggatgaagataatgaaggattgaagttctttcggatttcatcttctttaaatcctttacaatcatttttaccactcggtttttatagtaaaacgggataagcgtcctcgatgcagaggtagtcaagcctggccaacgacgttaggttcagggcctaatccctagcggtccacgggtccaaatcccgccctctgcaccacttgtatctactctgattcttccttgcgtgttctgtccacagtatcaggatttatgaaatcggatgtgccagcatgacattgttgtatctgtccgatgccggcatctgtattttcctgtgacgttaatgttcaatatgatgacctccatggaacggacggagcattgagatggcgcagaccactcttttcggggacgtaccgaagaccgggaagtcggaagggataatgccgttggcaggccgtatgaggcctcgcgatctcgacgagttcgtcggtcaggggcacctcctgggagaaggcaggatccttcgcaacatgatcgagcaggacaaggtcccatcgatgatattctgggggcccccgggggtaggcaagaccacgttggccggtataatagccaatcgcaccaaggcggagttcgtcagcttctctgcagtgacgggagggaccaaggaagtcaaggagatcatgtcctccgccgagaagagaaggcagtccggaaggaggacggtgctcttcgttgacgagatccatcgcttcaacaaggcccagcaggacgcattcctcccttatgtggagaaaggcagcataaccctcatcggggccacgacggagaatccgtccttcgaagtcaactccgccctcctgtcgagatgcaaggtgttcgttcttcagcctctgtcgtccgaggatatcttcggacttctcagaagggccgccgagaagggattccccgatctggaggtgtcggcggacgacgacatcctccgcataatctcggaatacgccaacggggacgcgaggaccgcactcaataccttggaggccgccgtcgccgacagtccttccgcagacggacatgtcacggtgaccaaggatgcggtcgcagattgcatcagccggaagtcccttctatatgacaaaagcggggaggagcattacaacatcatctcggcccttcacaagtccatgaggaactccgacccggatgcggccgtctactggttggccaggatgcttgacggcggggaggatccgtgctatatagccaggagattgatagagttctccggggacgatgtagggatggcggaccccaacgccatgctcatggccacgtccgcattcttcgcatgtaagaacatgggcatgcccgaatgccgttacgcccttgcgcagacggtgatatatctgtctctggcaccaaggtccaattccgtagccgtcgctatagacagggccctgtcagatgtaaggaacaggcctgcggagccggtccctatgcagcttcgcaatgcggagaccaagctcatggagcagctggggtacggcaagggttacgaatacccggagggtactgaggagaagatcacgaagatgcaatgccttcccgattccctcaaggatgcgatatactacacccccggggaccgcgggaacgaggcgttctatcgcaagaggctcgaagcgatacgcgattggaaggcaggaaggcgggaagaccctccagagtgatacatgacccagacatcgttattcacagacgaagtccatgcaggcgtctcgccattggccgacaggatgcgcccgcaggatctggacggtttcgtaggccagcggcatctcgtaggtcgggggaagataatccgcaacatgatcgagcaggacagggtggcctccatgatcctatgggggcccccgggggtcggaaaaaccaccctcgcatccataatcgcgaagcatacggccgcagaattcgtcgatttctccgccgtgaccggaggtatggccgacatcaagaacatcatggcggaggccgaggtcaggaggcgcaaggggagacggaccatcctgttcgtggacgagatacatcgtttcaataagacccagcaggatgcattcctgccatatgtggagaagggtacggtgaccctcatcggagcgacgacggagaacccttccttcgagttgaactccgccctcctgtcgagatgcaaggtgttcgtcctcggcggattggagacggacgacctcgtggatcttctcaaaagggccgcggataagggtttcccgggaaagaacgtacatgtgccagatgatgtattgcacactatcgccgaatacgccaacggggatgcgaggacggccctcaacactttggaggcggcggtggagttctctcccgaggcggatggtgtcacggaggtcccggaggacattctcgacgggaacatgggtcgccgctccgtactctatgacaaacacggggaggagcattacaacataatcgcggccttccacgaggggatgaggaattcggacccggatgccgccctctattggctggccaggatgcttgacggcggtgaggatccgtgctacatagccaggaggttgatagaggcggccgcggagacggtaggtctcgccgataacaccgccctccgcatggccacttcctgttattatgcgtgtcaggagctcggagagcatgaatgccggacaatattggcagagacggcgatatacatgtccctcgcccctaggaccaacggtgtcccgatggcgttgggacgtgccttctgggacgtccaccacaatcctgcggaacctgtcccgatgcagatccgcaacgcacccaccaagctcatgaagcagctggattacgggaaagggtatcagtatgcggaggatgcggatgagaagatgacgaagatgcagtgccttcccgattccctgaaggacagacgctactatgagccgggtccgaagggcgacgaacggttctacaggcgcaggttggatgccataagggattggagatccggaaagagggagaatcctccccgtcgatgtgccagatctttttttaaagccctacgaacgagaggatcatcccgacagttatggccgctataaggatcagggcgacacccgtccacttcctgtccccctcctgccagaggcatttggtggacaccgccacacctgctacgggtgtgaatatgaggatgcctatcccggccgtgaggatgtcctccgatatgtcgaacgacgtaaggaggagccctatggccattattccgatgccgaggacggtgccggccctgaggacggccgaggtctgcctgtccatgttgctcaaagtatccctccggcctcgcagaacattatggcggctatggcgaagaacacgaccgacatgtatctcttcagggatttcgcgttcaccttggatgcgatcctcgttccgatgagcgctccgacataggctccgacggccacggccgctgcgacgtccaggagtatgtcgccgtgtatgaagtagatgaccgccccggagaatgccgttattccgatcatgtagctgctggtggcgctggccacctttaccgggacatgcatgtggatgttcatcagggggacctttatggcccctccgccgacaccggtcatggatgatacagctcccgccaccgtgcagagcgccatcccgctcttcacgttcttcacggtatacttctgtctcgggggatccgccgtcgggtcctcgtattcgaaggtcatggggttgccttcctcatgttccaccgtcagtttttccggcgatacggccatcttgaatccgctgtacagcatgacgcatgagaatatcaccagcaggaccgtattatccagatagatggcgacggccgctccgattatcgcccctgcgcacgtggtgatctccatcatcataccgaggcggatgttggaaacacccttcctcacatacccggatgcggaaccggtggaggtggccacgatgccgaccaggctggcggccgccgccgatgtcgcgtccaggccgtagagtatggtcaggacggggatgaatatgatgccccctccaagtccgaaaagggcgccaatgacgcctgcaccgaccgcgatcaggagcagcgtgagcagaaggaacggttccatcgtcccgtccatgcgggtaccgctaataaaagtgacgtctggtatgcgatatattaaaaagcgtccggcactgggggaaggtaatcattatagattcagttaactatggtgaaccatcggtcgggttgagcgcaatggcagtcttgttgatcaggtattcggagattggacttaaggggacggccgtcaggatcagatgggagaaccgcatgaaggacaacctcatgcagatgctcgagcacgacatggtggaggcgctcgtcaccaaaggggaggcacgcttctacatcgagacatccgacctggacaaggcgatccgttccgtgaggaaagtattcggtgtggcatccatatccatagcggagacatgcccttcggatgcggaaagcatatgttccgcccttgccgagtattccaagtcgcgtatggtcaaagggaagacgtatgccgtcaaggcgaggcgcgaaggaagtcagccgttcacgtccatggatatagccagaatggtcggtgacgccatatggaacgccaacctcgataaggatccgcacgtgaacctctccgctccggacattacgttctgggtggaggtcaggcccaagcagacctactatttccaggaatacatatacagtcatgcgggactgcccctcggcacgcagggcagggtggtggcggaggtcagggacgaccggggacttctgtccgcctggcttatgatgaagaggggatgcaaggtgttcgtggacggggactattgcctggatatcctgtccgaatacgaccctcatctcaggaccatcgaggacggaaagatacccgacaggaccctggggttcgtcaaaggatattctgtcgacgacatcgagggattcgatcaatccgagtacgatctgccggtctacttccccacggtagggatgaccgacgaggatgtggccgagagggtcgccgccatacgtgcagaggccgaggcatctccctccaggtccgtctgatacgtgccagtactcaggttttgttgtaactggatgccggtgccgaacggccctggcgttttattttaaacccgtaggtattcgcacccgtatggcaaagtacgtctgcacggtatgcggagagatctacgatgaagagagggaaggggtgaggttcgaggaccttcccgatgactgggtatgtcccctgtgtcgttcccccaagagcgcattcgtcctgatgggggcagaggctcccgtcaccgaatccggccctgcggaggaagggccttcctcggtcgccgacgtatcggacataggatacgatcccaagcttgtacgccacgacggcggccccatggacgagatccatgccatggccgtcacggggaagagtgtcggggaggccatggacaccctattgcccgttcccaagttcgacgacatactgatcctcggagggcagctcgcccatcccccgaaggacgacggtgccgacgtgagcatacgtaccgtgatcgggaagaaggccgagcaccccatggtcctcgagtccccggtctacatatcccatatgagtttcggagcgctttccggaagggccaagatcgcccttgcgaaaggggccaccatggcggggacggccatgtgcagcggtgaagggggagcactctacgacgagatgatcgcatccgacaactacatcttcgagtacgtacccaacaaatacagcatgtacgacgagaccttcgagagatgtgccgccgtcgagatcaagatcggtcaggggaccaaacccggtatgggaggacatctgcccggtgcgaaggtcaatcatgtaatatcggtcatgagggagaagcccgaggggaaggacgtcctcagtccttccaggttccccgagatcggatcccccaaggacctcaaggagatggtctcgatgctccgcaagaggagcggagggaagcctataggagtgaagatcgcggccggccacatcgaggaggatctggagttcatatccaaatccggttgtgatttcataaccattgatgggaggggcggagccaccggttcttcccccaagtatctgaaggatgcctcctctgtacctaccgtatacgccctctcccgtgccaggaagtacatggacgagcacggtatgaaacaggagctcgtcataaccggcggtcttcgcaccagcaaggatttcgtgaaggccatagccatgggtgcggacgccgtggccgtcgcctcgtcggcactcatagccctcggatgccagaggtacagggcctgcaacagcggcatgtgccctatgggcatcgccactcaggatccggaactggagaagaggctggatatagacgtcggggcgcagagggtcgccaactatctcaatgtgaccgccgaggagctccgttccttcacccgcatctccggacacgacgatgtacacgagctgtctttggacgacctctgtacgacggatcccgagatagagcgcataaccgggataagacacgcatgaatccatggggccacatgatggcccctcggactcatttaaacgacaaaaaatattttacacatcatatgcaggtcagatacacttcccgagcgtgtccggccagctgtcttttccgagaaatgacctgtccacattctgttccatcctgagatacagtttgtatgggacggagaaagtgaacttgtcatggtcgatgaacctcctggcgtacaggtcggtcattccgaggaccgcatgggggtcgtcggattcaccttccgccctcggtatggcatagacctgctgacaggcgtgtccgtatggggcgatcatggcggccccgggagtcttcttatcgaatcctgccaaaagggccaatgcggatatcctcgtcggatccgcgatgaacacgacgacttctatgtcccttccctccgccatcgcctcttcgaggtcctggaacactatggcgtcgtttccgtccccgtagtcctttatcccatccagttgcattctggcgatatcggggcacatgaagtgggcttttccgccgtgtttggagtcggatccctccgggagtacggacagattgcatgcggaccgctccctgtcggggatacctccgaatccgaatccgctgagtgctccgtgacagtagacatgctccttatccgcggcgcatttgacgcccgtccgggcacatttcatcaggagagacggtatgctgcagtgtgcagaaggaactgacgcatccgcagggatcgaatccgtacgatagatcgctacaggtcttgtgctgagtttgatggcatccgtcaggcggctcatggtctgccatccgccggagcgtattaaacccgtcggaggacggactgattatatgtgtgtagaaaagcacctgcccgtttccaggcaggttaatgtgtttaaggaaccgccggttaaggcgggagttgacttcagttgttcctgttgccgttagcagcaccggaaggcctgaccttctcggcaccgtgtcccttgttcctgagtccgcgtcccttctttccggaagaggtcagaccgcggtagacacggttcttgtgcttgttgttgcagatccagttgatcttgggatcgtgctggatgacagggcatgcggggtccacgaggattacctcgtaccactcgtgctgtccatctgctccgacccagtagctgttcagaacctcgaggttctggtatctcttctgggtcctctcttcggcgatgctctggagggatttgctgacgatgagctgctcctctcccttcctcttggccctccttccggacttgatctgtctcttcttgaaggcacccttcctgacctttgccctgacgaggacgtatccctgcttggccttgtagccgagggcccttgccctgtcgagcctggtgggcttctcgatgcggaggaagttctcttctttcctccactggatcttcctctcctggttgagggctttcacataggtctcggaactgttcgcccaggcctcggagatgtacttgtacatgctctttccctgaggaactttcttctcggtagattcatctgccatttcaatcaccttttcggattcgcccttgcgggtacatttccgcggaacacatatgctccgtaggttccgcagatgtgaaattcgtatttaaacctgctattatagaaggtagcagacgaggtcgcgccggccggaatgtcagggatagacattggcactttccatttttcaggtgccgtaattagggggatacagcattgttaatcagaagaaagttcgtaaccaagggttacattcgcctgtcctgcgcaacagcgttcgtcatatgacgaatactctcctcctcatctgctgagtgcttctagtctcgttggattaaataattattccatggattgatgggattaagtgtactggatactacaatgtcgtgccgatgtagatagaatgcatccaactcgtcatcctttttgtcgacgaatgacttactggctatgtccgatgacaggcgtcgtacagtatgggttttccgtatcaattcatccaactgcacatggcgtcaaaagaattgatccaaggagacggtcttggattttttcttttgtattttttcgtccgtactctttttgacgtcctcaggcccctcctttttcggccttaagggtatgaagtcatcgtcaaagagggttttctgctgtgatcccagaagaaggtccgcctccgtccaaccgaatacctcggtgatcctggaagccatttgtgccagacgtcctgcgtaatagcggtagtccggtttcttattgaacgggactccgcttatgaacggttccacctcctgaggtgcggtggatgcatcggtgacgatccaggatatcttcataccggggatgaagttgtatcccatgtccatcatctttttcgccgcttggatgttggccatgcgttccggattctcgtaggcgtccagtcctttgcaggtgcgggagatcacgagatcctccggcgggactttcccggccatcacgtcacgtatggtgtcctttacaagtgccagagctccttcgttgtcctcgtcgaggatcttcccgaacagttccgtgagcatcctgctctgcagatcgaaagagtccgagcggcgtatctcataccctctgacaagcaggtcgtcatgcttttccggccatactatcctgccgacatatctcttcttcatcccatgggagaacagaggctccatcaacttctcgaattccagtgtcatgccgttcttcgagaaacgttcggattgcgtcttcccgaattctaccgccccttccaggtcgtgtttcggggacaggatgaatacggagtccgtgtccccgtatatcaccgggtgtccttccttctccagactgtcgatgatcccggttatgttctttctggcgaatgctgtaatggaagcccctatgcttttgtcggtgaaacgatagaagtcggatgcgaaaacaccgtagaaggtgttcatgactatcttcaccgctgcctggagcccgtccaggtagctgtgttccgccggatcctccgtcgccttcatattcctctttatggaatccctctgggccatcagtcccgacagaatggtgggcaacagtcctctcttcttctcaggggaggcatatctggcccctgacggcgacactatgtcgccgtcttcgcacagggtggtgaaacatatgttgttggctatgatgagcgagggatacatggatttgaagtccaggacgatgacccagtgatacagcccgggcttcatcgtatggacataccctcctgcgatctggtcgtccctctgggccttcctcttcccgctcatggggactccgacaccgctgcggtccgcggcgcgtatcagcagggagtccgccaaagtcgatgttccggagacgaggacgtcctccacaggcagtttggatacggtcgcaaggtccatgcccttccttatcgtgccgacggtgaggagtatgcggagtgccagattggcatcctggatgcagtattcgatgacgcgggcacggttgttcttccactcgtcatccatgtgcttggggtcgacgtcaagcttctcctcccccaggatgagtttggatacggcgttgagggtctcctgtttcggtctgagttcctttttcaccgcccaccatgcgtcggtgatcagccttcccttcaccctccagaatctctcgctgaagagcctcggttgtccgcggtcccttccccaaggtaatgcatccttcatcctgttgtattcggcccgttcgattatcttcctgatatcgtagttgtcgatgttgtatccggttatgacgtccgggtcgacgctttcgatgagctctgcgaatttccttatgatctccttctcgtccccgtatatcggatcgggggtggtatactcccccgcctcctccacttttgtgcaaatgcagtagatcgtttgctcggtgatgctgttctctatgtcgaaggacaggaattttagaccggggtcgaaggaatctatgttttcgaacccctccatcctgatctttatgtctgtgcagtagtcgaggtccacatcctcccccgtcacccgtatgcaggaccccatgtccgtgtcgtagatgaagcggtcgtgatattggatgtccccggcaaggacggtgtatctccgggcaagacggtttcttatatggggtacggaccaagggctgtccaaggtgatcttcaggcagtcgcggacctcccctttgtaatataggtcggtatgtgccagatcgacgatctccttatccgtcttcaggctctcttccgcggatgcgtccggatcaactatgaagaaatagggtttgaatccataggcggctatgagtatggatctcctgtcgcgggtctttccgaacagttcgatgtagggctcgccctctctgtcgctggaatatgatgcgctcaggagtcttacgtcatatgtgccgcccatgatggttctcacttattggcgactatccttatgatgtcgccgggttcgaggacgtagtccgcccctacggtgcgcttcgtcctgcagttcacagctctgatgaacttgtctcccaggtcggtgtggatcctgtacgcgaggtccctggccgtgctgcctctgggaaccagatgacagtcggggaggacgcggccgaagtgatcgcacagcttcccttcgtcttccacggggaatacggggatatagtcgagggtctcgtatacggcatcctcgaggcatgtctgtatgccggtgcctccgtacttctccatgttctcgcgcatgtattcgagggctttcttctgggcctcgttcatgttgatgccctcttttatcttgaaggtcttttctccgggaaggtattctacgatccctcctttgtcggccttcttgagggccaactcggtctcggccatggtgggtacggctttgtctcccagggatgatacggcctccaggttcttctccggtgcgatatctgccttattcatggcgatgatcatgggcttggagatctttctgatctctccgcagagtttcaggagcgactcgtcatcccaggcggtggggtctgccggtagaggggccttgtccagagcggccttgatctgcccttccgttatcttcagtccgttaagtctctcggccaggatcgtctcgggcttgctgccgttcatcttcgcctgtctggctatctttccgagaccgtctttgatgatctccctcatccagcagtcgatttcatgtctgaggaacgtgacgtcttccgtaggatcgaattccccgacctttccggggatcccttcgatattcgtgctgccgctgacgtccacgacgttgatcaacgcatccgcctgcctcaggtcatccaagaatttgtttcccagacctttgccctgccaggcgtcggggaccagacctgctacgtcgaggaggtcgacggggatcatcctcgtaccgtttatgcatagggagttgtggggattgcacgtgacgccaagctctttgcaggggcatggatatctcacatatccgactcctttgttgggttcgattgtcgtgaaagggtagttagcgatttctacgggggccatggtggccgcaccgaacatcgtagattttccgacgttaggttttccgacgatgccgatttgcatataatcgtgctaatgataggatggttacccttataggttgggatggctccggcctcgaagatgaggctggaaatcattaagcaatcagagagtgcgtttacgatcactcgacaaaatcggtcgcatatccagacgatctctgcctctgcaaggttccctgtcaaacgctgtttttatcggacttcttggcccatacggcgtcggcgatctcaccgatctccacaggtctcagactttcgatcctagcgtccgcatatggtatgtcctcggaagagtcgatcattctggcacttttgagggatgtaccgatcttctttctcctgtggtcgaaacacacccttgttacgtcgaagaacgtcccttcgtccttgacggtgaaaggtgccgggcgagggactatcgatacgaggcaggaatccactttgggctggggattgaatctgctgcgcggtacgttttcgaggatctggcactccgctttgtagaacaggttgacggtgaggcgggagtaatcggggctgcctacgtcggcgaccatcctctctgcgaactccttctgtaccatcacgacggcctttttgaacggatattccagaagcttgaatatgataggtgtggagacgctgtatggaaggttgctgacgaacctgtcgaacggagggaaggggatcttgaccgcatcgccatggatgagtttcaaacgatccccgtaggtcttcccgatgtattctgcaaggacgtcgtccagttctatgcaggtcaggtcgtccgcgatctccacgagtctctgggtgagtatgccgaggccaggtcctacttccaggaccctgtctcccggacatatgtctgcatatccgatatggcggtcggcgacacgtccgtcggtcagaaaattctggcccttgctcttgctgggtcttatccctgtctcggctatgagccgacctgtctcgctcatctgagcacgaacaggtagcgcttcctgctgggatcggtgatctccagtacgatgcgggcgactatcagcttctcggggctcttgaccgcagggactctggtcacgaggtcctcatatcctttgaacggtccgttcttgtctctttcctcgagaatggccatcatggtcttctttccgagaccgggaagttcctcgaggaggtgcttcttgatggtaacgggtcctgcttcgttgtagaacctgatgaagcgggtctcattggctttgactatggcctcgacggagtattcgagttcggaagacgccatgttggagaggtcgtcgtatccgatccttctcttcacgtggtcgatggcggttctcttggccgcatcctttccgatgtatacgcggtcgccgatgttgatgacggcaccggtcttcgccacaagctcgaagagcttgaattcgttgtctccgagggcgtagacgacaggttcttttttatcgaacttgctgacgccggtgccctgcggtagataatctagaacgtatgcgtattcttccataggtggttcctcctgttcagaggtagggtgctacggtgtcgaggatctgatcgatcatctctgcatcgagcggacgtacaagcctctccttggagcagatggcacgtacgtctacagggtacttaggaaggatatcggcgatttttaccgccaatgcagggttgtccttgacaaagtcgagctcaaggagcttggcgataagctcgtccgcctgctccttggtgatgtggcagacgtcagtcgcctgggcgagggcatatttctgcatggggagaagttcccttttctcattctccgcagtcaacatgtcccttacttctgccaatgaaacgtactgtccgtcagtcatattacatcacccgctcgaaatatgtgaattggtttactgaactgcctttacgaggtgctcggggcgggagacgacgatcttggtctttccgccgacgttgacgctgacctcgtatgccgttcccctgatgccggtgacgacaccggtaagtccgtggaacctggagtgcggcattcccttgtggatggaggggtcgatgacgatgttgaccttctctccctcttcgaaagtctggaatcccctggtgatgggggaaagtccccttgccctgggcttcttcttgagaagctggcgggttttggatctgaatcctctggatctctgcatttatctcaatcctctgataggttttgagcggtgccgaacaggttcggtggattaacctaatcctatcgcacgctcgatttataggacgaggctatcggctctttgtttattaaccttgctatctccattctaataaatataaagggatgaaaggtcagtcgtccctgaagtctatctcttggacatccagaaggtctaccttgcactgtgcgccgtatgtttcggagaagttgggctgggtccttccttcgtccccggagacgaattccttgatgtatgtccccgactgggtcttcagcacgaggtcgaagctgtcttccgttatgttctcggccttgatccaatacaccgtcctcttccttacgaggtcggctctgcgatgttcgacgcgctgcggggtgcgttggtcgagacatacgtctacgaacttcgaggccgtttccttgaccttgtccggatctatcctcccctcgcacaccaccttggcgcgatacgtcttgtccgggtcggattccttgtacatggcgactgccgagcggggtacgaaatggaggccgtgatattgtgccagtatgctctcgttggccctcgcttccagttcgtcgaggtcgatatcccttatgcgcggctggctgatctccaggacgaacgggcgtccggttcccaacatgcaggcgtctatgtcctccctgcccatgccgtggaagaactgttcctgtccgtcggccatctccagggctatgtcccctatgatctcctgtacggaggtcatgtacatcttgcccgtcccatggcatctgggacatcctttcccgtggcatatgcggcagggccatctggtctgcgggatctccctgctgagtttgttgtagcgtcctgcgatgaatatgggcgagcagtcgagggtgacgtcggcgaagcgggtgtcgatgcatgcgacgacctggggttccttgaagttgacggcacggttgatcatggggagggccaccttgcctatctccctgttgagttccgtcttgaggggttcggccgtctctttgaggccgtattcctcgatcatctccttctccctcttcgtctgctcggggtcgatcctgcatccgaccaggaagttgtcggattccaccgtgttgaccttgtcggccacggcctcggcgaagcggggcaccatgtcgaaaacatcctcgcagagggggcatatatcgtccttctcgaagacctcgccgttatcggcgagagccgccctgatcatctgtccgcggcgttcgtcggtcaggttctcgcccagtttggcgaacatcctgccgaggcagtggtcgcacaatcccatctgtgccagacccttgcctttgtccagaatgccggatatccattcttccatgcgggtccctcagaggtcgaatcccatctcggcgatcctgagtttggggcgctgggattcgagatagtggtagacggtcgagtgttcgcttccgtggagaagcatctcgatggcgttcttggctatggggaggcttatggagttccctatgatggagacggtgttgccgtatatgcacagatagacgtccgccaggtcctctatgagtttcctggtcttcccctcccttccgatgatgcgtccccttgtgcgggcgacctggctctgtctgtcgccgacggcatccttgatgtcgatggtctcgaggtacatgtcgtcgtcatcgagtatcttcatggccttgtcggggttgaatcctctgccgatggctttcacgacatccatgatcttcagggcgtttatgggctccacgccctcggcatcgtcgaagatcatgacccctccttccttgtcgacctgtatctttatgcccgtccgctcttcgagaagcttcttggatgctccttccttacccacgagagcgcctacgcggtcgccgggtatcctgatggatctcattcctcgtcatcctcctcttcatcgtcgtcttcgtaatcttcgtcttcttcatcgtcgtcttcgggtgcgaagcactcttctttgatcttctcggggtcgacgacgtccgccccgcggttcttgaagaacctgttgatgttggcgatgtccctgtcgagcaattccttggcattgaagaagtccgccgtcatggcctgtccgacgtcgatgacgaccggttcgccgtcctccatcagtatgttgtattcgctcaggtcgccgtggaccagatgggcatccctccatccgtcgattatgaaagacacgacctcgtcgtaggtgtcggtgggatcgtcgagttccacgcttctgagctggggtgccggactggtctcgtccccgatgtactccatcagaaggcagttctgcgagttggcgatcggttccggtacgggaagctccgaatcatagtacctctggagattcctgaactccttggccgcccaggcgtagatgaacttccatctgttgccggtggtgcctttgaaacgggggtctccctccacatatttggccaccttcttgaaggtggatgtcgacgtcctgtagatcttgagggccagcgggtctccgtcctcgtcggtggcgtagaagacgttgccctcttttcccgtggatattgggtagtggaccttgtctatgagccctctcttcatgaagtcgtagatagtcatgagggtcttgcggtcgaagacctcgccctcggtctggtgttcgtcgcctgtcctggtcgtcttgagggcgtctatgcgcttctcgaggtaggcgtattgctcttcgtatgaaggtgcgggcattggattcctttcagaagatgtcgaggttcttcgggatcttgttcctcttgctgaggttgacggcctgggtcttggtgtacctgaaccttacgtcgcatttcgacggttcgaagtcccaaacggccactatgaggaggtcgccctctcttatccacatcctcttcttgatcttgccggggatgcgtccgacacgggactgtccgtcctcgcacatgaccttaatcttgctcgctccgaggagctggtcggcgatgccgaacatctccccttccttgatattgggcagacgtacgcgtgttacgtcctcttccgtgctttcaaagggtccatctaccatgataacatctcttttcccgcccatgcgattacttggtttataaagttttgtccttttttattaagggaataatgaaaggcgggtcacaggaccgccggcggggccgttaacggacccataacaatctttttaaatcaatcccagcataagaccgagtactgctctagtagtgtagcggccaatcatccggccctttcgaggccgggacccgggttcgaatcccgtctagagcaccattctcttatcccggtcatgggtttttccaccgtcagggtctcagcatcccggttctctcggcatgtgtctttcgtcgaccttcttggatacatggtacgaaagtcccatcatgaggatccctccgaatacgtagactcccacgcatgcgattatcagggcttcgaaggagtagagggaggcggcggcataggccgtcagcttgcagactccccataagagcatggccgccgtggagagcttggacctcctcaggacctgcagcatgcaggacccgagtttcctgaggccgtcgaacgggatgaatatgcagaacatgcgcaggacccagaccagctcctccttgtgggaggccatggattccgacgtcgtgaagacgcccatcagggggtcggcgaagacgaatacggtcagggcgatggcggacgtgatcgctatggacagtttggcggaatacaacatacccagcttcatcttggcagtgtccttttgaccgagtgcggcggagcatacggggatcatcgcggcccctatggcctcggccgggactatggcaagggtcggatacctgaacgggacgttgtagagcatgaccgccaccgtccctccggccgcgattatgaagatcctctggaggatgttggtggtgcctgtgacgagcgcttcggcggtcctcggacccccgatccccatcacctccgccatcaccccgcggtccggacggaatcctctgaaagacagggcgacgttcatcctccccgacatgtaccagtaaagacccagggccgtggatatcagtgcgccgacggaggtggcccatcctgcccccgccacccccatcccgagtccgtagatcagtaccgggtccaaggccatgttgagggtcgcggacacgatcaggacgatcatggatttccttccggcaccttccgacctcaggagaccgctgattatcccgttcagtatcagtgccgaacccatcgctatgaacgggaagacgtatgcgacgctaccgtccctgacctcatccgcccccatgaggtcgattatcggatctatgagcagcatcatggcggccgatacgaacacggacgtcagaagacccagcacgacggagttcgccgccagcttctccgccctctccatgttcccctcccctatgcggaacgagatggtggatgcggcccccacccccaacccgacccctgtggccgtgatgatccaatatatgggggacatcatcgagaccgcggtcatgtccatatcgcccagaccggaggtccagaacgtatccacgaagatgttcagctgtatgacgaggtatgacagggaaagtgccgccgccagagagcgtatggcctttttgggctccccgagcatcctcctcatctccctgtcgtccttcttcacgatgcgggggatgcaatcccggatttaaccgttggtacgggacctatcgacatgcacgtatgcggatttccggttataaacgcctaaataccacctcacattcgcccggtcattgtcttataacattgcgggagaaggcgggttcaggcccaacagtctgtccaaaggcgcccttctcctagcttccatgctgatcctcatgggtgccgcggcggtagctccgtcccttaacggcatcgaagaggagttcggtgcggggaagttccttacttccatgatcatcacgcttccggcattgtcggtcgcgttgttcgggttccccatgggttcctttgccgacaggataggtatggcgaggacgttcatgctctcgctggccctgttctccgtgttcggcgtggccggttatttcgccgattccatatggttccttctcgctaccaggttcgtcataggtatcggtatcgccggcatatccacatccaccaccgcattgatagggatgtactattcgggcgaggagaggaagagggtcatagggatgcagtcggccttcatgggggtcggatgcgtatgcctcgagatagccggagggatcctggccgatatcgcatggaacgttccgttcctcatctatgccataggtgtccccatactcctgctggcgtcctatggtatcagggacgtaagacccagatcgttcgatgatgggggtatggagcggcaggagatgccccataggaggtccgtgatggccctttgctacgttgcgatcttcgtcgccatgttcgtgatgttcacgataccggtgaacatgtcggattatctgacgaggatggatgtcagcatgactctttgcgggatcgtccttgcgataatgggtacggcccaggcggtggtctcctccctatatgccagatccaagaggaggatgggtatcgcttcggtcttcctgctcggattccttcttcaagcggtcagtctgtgcctgctccatctggagaatttcccggtgacctgcatagccataatgctctgcggtatggcgatgggtataatggtacccacgatagtgtcgaccctttcgatggcatccccggcgggttccgaggggaaggtgatggggatatactccatggtgatgaatctgggatccttttgctccgcattggtggtggacgccctcatcgagtcactggattttgcggatgcgttcctttacgtaggcatcgcagccgcggtattcgcggtcgcggcggccttgttcggttcccgcatgaataaaaaagcagtctgaaagattccgcggcagggaggggatccaggctcctccctgcccggtggacgtcaattcttctttctgtacatccatctctttctgaacgcattgcttttggcggccacgtcccctacgttgccgcgggtgatgcggtatacctcgggaagcttcctcggattaagtgccagcatgcggtccatcaggtttctgtcggggcagtccgcattcttcaggtagtcgcggttccagttgtccacgaggtcgaagacgccctgtatcccggtgctgtagaattccgcggcaagtactgctacgacggtgcagtccttggagaggaccgcaacattcgctccgtggaccgcgaactcgctgccgttgaacgacagggacagtccgttcccgtccttcacaaggtccatcacctggtagtcgattatgtcccctcccacgtatatggtcccatcgaggtccacctgggtggacttccttatgtccagaagggcatacgccttctcgttggcccccacggaaacagtgttggagatcatatccgcggcggccgtcccgctgagcctgttgaggaagatgtcgtccagggccgagatcatcctggtctctgcggagctgagttccaggggaacgtccagctcgtacttgtcacgaggcattttcagctcgacgatctctttggccatcgtgcggaggtcccagcattcctgccgggtcatgccgcatgcatcgtcactcaggtcgagggaggtggaactcgccatgcctctcgggatctccagtttgtcgcagagggcgtccgtagcatgttcgtacatgctgctgtccatgaaggtcggcatgacgtcgatgaagtacttgatcgtctccttggcactgcctgcggtcgtcaggtgctcctgatagaacctcattacgtcgtagtccgtcgccccgaacgccttcaggaagggggcgaccatcctgacggtatcggccccgcggccttggtcgtcacggttcagtacgtaggatgtgacgatgccgtacctgtcgatcaggtcgtagaacttccctccctgcggtatgaatctctcgcagaggtctctgacggtgtcgcagtccgtcaggaatccttgcggttccaatatcgtctgtttgtcatgtatcaggcccatatccgccatcggattgatctcgtccggcactcagatcgccccatccacttctttcgagaggtcgtaaggtccgtcgagtttcttcccatccctccacagccttttgtccctgatgcagaccttcccgtcggcgaacagccttatcgtctcgacgatgaggggaagctccctcttcgccccatcctcccttatcctgcggaagagaggctcgtcctccccctcctcggcccttatctgttcaaggtccttggtcttcagtttctcgtacatctgcgcccacagggcgtcgtagtcccctccccttatagggaagcggcaataggtgagggcgtcgcccctgtcgtgctccttggtgcatatatgcatcatgaccccctggtcctccgcatcttcgccgatgagctgccagatgacctcctgccatgtgcctttcggacctgtcgggagggccgggtgcaggttcagcatgtcgtaggcgtcgcaggtctcatcgtccatccacagcatgtatcctgcgaggatccccagctgcatgccgtacccctgggtcttctctctgagcaccttcccgtattcgcttccccaggccgcctcgtcctctttcctgagttccggcatgaacttcttccacgattcggtgaccaggggtatgccgtagccctccaccatgtcgaagaacatctgtctctgttccttcctggagttgggtacctcggtattgtcccagttacagaagacgaagggtacctcgatgtcgaggcctcctttctccttctcatccatgactgctttcagaaggttcctggagcccggaccccttccagtggagaaccagcctagttttagcatatgtctgaccgtatgtctgcatccctattaaagaaatagacgattttccgctcatgcggcgggggagggtgctgcggatcagacgtcgaagaggaccgtgacctccggtttttccgggtctatcctcatcatgtggtatgtgaccgcctttatctccccttttatgtgcatgcgggaacggtccaacttctcgcccgcacagtcgcatacgatgcggtcgccgtcgatagaaatcgagaactggcacatgattatgttatcgtagtcctctatgaagaggagttctgccagaagcgagtacagagcatcctccgcatcctccccctcgacttctatgtgcctcgtctcgacaggctctatgccggagaggtccaccgtctggtcgaacatcccgtaggccaggttggcatagcattcctccagtgtggagccgtatcctctgatcatgagatcggcggtgtggtcgagcacctcgtacctcttcatgtaccgaccatcccctcggtaggattagtaaattggcatgggcggggggggtcggccttcagacccgacgatatccgtgacgcctccggtgcatcggaggcgcaggctgtgacggctgttccagaagaccgtatcccagatcccgggggcggtacttttcaaatcgtttcatttttcgaaaatcgtaaaacgatatactgaaaaatattgtaatccgttgattgatgacgattattgtagataaatcatcgtaatttaggatactatttaatatctgacaatactaacaacggaaacatgagaataactatcgtcggatgcggttccatcggctccaggctggccaaggccgcggatgacatggaagaggtcaagaggatctacctggtcgacataaggaaggatctggccgacaatgtggccgcctccctcaggaaggcgatcgtcgtggattccgtggaggacgagctctaccactgcgacctagtcatcgaggcatcctcgcaggccgccgccaaagaggtggcacctaaagtggtcgcgagaggggtggacatcatgatcatgtccgtcggatccctcgtggacgacgattacaggaacacactcttccagagtgccaaagagcacgaggccaagatattcatccccacaggggcattgtgcggcgtcgacggtctgagaagtgccagctgcgatgagatcgattccgtcgaactcatcaccaccaagggtccgaagtctcttgcgggcgtacagtatctcgtagacaagggcatagaggtcgacaagatcaaagagaagacggtcatttacttgggtcctgccagggaggccgtcaagatcttcccgaagaacatcaacgtggcggccaccgtctcccttctgggtctcggtttcgacaggaccaaggtcaccatagttctggatcccgcggccaccagcaactcccacgagcttaggttcgaagggaaattcggtaaggccgtggcacacacattcaatgtgcccgaggccgataatcccaagacgtcccatctcgccgccctcgcggccatatccgctctgaagaggatatgcaggaacgagtggataggggtctgaaacatcgatcctcttccggaggccctattctgcaagggcctccggcatacctcggtccggttctttcatttccttaaatgaaaacgtgcgctttttgcactatttctaacttaaattttatagcttacgctaaaaaactctccggaaattgctccaaggactgggaacaatctcaatttcctatagacggtaagatccgtaagatgacttttcgggcttggtcttcggcagtctccgtaattttttcttgtcggtctgcgtgattatcttcaggcactgtgcgtggacgcagtccacggcacagcccctgtcgctgaagaacctgtacggcggataagcataggtaccggtttccatcaggacacagaatccgctctttcccacatggtcgaaaagttcggcgagacagtcgcaggttccgtccgttttcttgaaatccttctcgaaaaccaccttgcccgcgtccgaaaggatgcaggcggtgatattatccttatgtacatccaggcctatgtatctcatgcggcattcgcctcctgttttagcgaattggtatcgaatgccgtacttttaaaacagtactcgatccaagacgaaagcgcacgttttcatttgctggtcattttcgtggggcgggttcacctttacaccgtccttcatatgcagtcttaactactccgatgcgatatgcggctctatggcaagcagatcagaaaggcttatggcgaatgcgcccgacatggacgccatagtgatcgccaacggcggggagaacttcctggattccacgtacagatatctcttggagcctacgggaggggtgttcgaggactgttacatagtggtcaggaaggacggttcccaggacgtcatagtgaatgtcctggaggaggagtcggcgcgtaccggccgcggggacgtcaaggtgttccataacaggtcggaattggaatccatcttcaaggaatccctcgaaggatgcaagagggtcggattcaacgtggattcggtcccctacagtacggtcacgggcatcaaaaaacttaccggatacgattatgaggtggtcgatgccaggaaggccgtggcagacaccgtggcgataaaggatgggaaggagatcgaggccatcaggaaggcctgctcgatatcttccaaggtggccaaggagcttcccgactatctttccgaaggcgtctccgagaccgatgtcgccaccaggatggagatcaggatgcaggagctcggagggagaggtctcgcattcgacaccatagcggctttcggacccaattccagcatgcctcactacatgccggccgactatcgtctgaagaagggcgatgcggcactcttcgatttcgggtgcaaatggggaggatattgttccgatatgaccaggacattgttcctcggtaagcctcccgagatcctggagagggcatatgaggtggtaagggaggcgcagcaggcggggatagacgcctacagggccggggccatggccaaggatgccgaccttgccgcgaggaagatcatcgacgcctccgaattcaaagggaaattcatccactcgttcggacacggtatcggtatggacgtccatcagcccatatacgtaagtcccagatcggaacaggtcctgtctgcggggaacatagtgtcggcggagcccggcatatacatacccggggtcggagggataaggatcgaggacaccgtactgatcacggaggacgggtgcgaaaggctcaccgatttcccccatgaactgaccgtagtatgacgcacatgtgtccacagtatgcgaaataatgccaatgctgggaacagatactgtaggttaaatacattgagtgggatgattactccatcgcgtcggggagtacggcaacggaaaccttcggcatccgtcttcggatctcgcagagagacggcgcgttcggatccgttcccgcagtgtaatggtctgcggtcggttccggagggtggggagcgttcgccccacccgatttttcaacatacgttgtttgtgatcccatccatctgggtcttttaacagtgctatgtgttaacgtgtatcaattgataagtgctaacaagtagcacgattttcatacgatgttccgaatatgtctagcaatgaaatcagaagtcgcagacgtaatgaaactcgacaaagagtacaagttgttcatcggggggaagtgggtctccgcctccgacggcaagaccttcacgaccgtttgttccgccacgggcgagaaactcgccgagtgtgcggaggcgaccaaggaggacgtggatgcggccgtgaaagcagccgaggaggcgttccccgcatgggccgccgtcatgcccgcggacagggccaagatactcaacaagatcgccgacatcatcgaggagaacatcccgagactcgctatgatcgaagccatggatgtagggaagcccataagggagacgacgatcatcgacatccccaccaccgcggaccagttcagatactatgccggtctgatcaggggggaggagggttcggtgaccaaggtgaccgaggaggccgcggcgaagatgctcggcgagatcttccagtgagcgtagggcgggtttatgcccgccccgttcatgccagaggtcgccttttcaccagacagaccttctggcgggggtccctcggattgagggggtagaggaaggatatctccctctcctccatgagttctgcgagacatctgcggaacagattgttcacattgctgtatcccacggctgcgcaaagttccttggacgtcatgcacccttctttcccgagggcctccattatacgtgttttcacatcgtccgaggtgttcctgcggttcttccgaggaatgagggtctcggacgtctcgtccaggaatctttcgttcaccgggaggactgtacggagataggtccttcccgtatcggtctcgcagaagggtcttccggagccgttatcctccatggccgatgtgatcttccgcattccggtattcctaccctcggcgagtcccatctctctgaggaatcctgtgatgcgttcgtttctgagggatgacgaccgcatagtcatgtcctttacgcgctcttcagggatacgggggtcgggacccggaaaactcatgacctcgatacggtccgggaacaccttcacggttataggctcggatatgcggtagtccttgtgacatacggcgtttacaagggcttctttcacactttcgtaaggccagttgtatgtgcggtcgttacggccctcctgtgtctttccgcggaccaccacgttcttcacgaatccgagggcacatccgagctggaaccccaaggggccttcgaagacattatctatggagcatcccggtccggaaaccaccgacatctctactctggccccttcaaagtacttttccgggtcatcgctgaacatcaggagtccggcgttgacgggtctgatctttcctgatatgcacctggcgaggcccatggtgcggacgagggtgtctttatcccctcctttgagaggacttcctgtacgggcaaggtggtcgttgatgaggtcccatctgatgtcgtcgatcgaagcttcgtcgttcgcagaatcgtcgaaacggtcgtattcaggccattcttcattgaattccgtcttatcatccatgtgcatccctaatgcttatgctcatgcatactcacatacttatgcatatgcatatgtgtagcggaaggcagtggaaatcaggtttggaaaggggttttgtccacgtgtctccccctcttccatccagccatgggcaattctttaaatcagtatgcgttccagattccaagggatacagattggttcggttctacaaatgcagcagttgcggtcacgtttttatctcggacgaatggagcgcttactgccctcattgcggggcccacggttgggaaaccgacaaggtgttcttcatgaaatgcagccaatgcggaaggacctatctttccgatggttgggatcaatcatgctcgttctgcggtgcgtccggatggagggccgacgatttccgtttctacgtgtgtaggaggtgcggaaggcacttcgtcagcgatccatgggacaagtcatgtccgttctgttccggagacgggatggaagattgatccccttctgtggatacggtccataatatcctccagtcttcgaatcacataggcaccgatcgtgggaagtcctttccggaatcatatgtcaagggggttcctcttgcgctccatatgtgcggtaggcgctctatcatgaggttgatttccagatataggttggaatccttccacaaaatcaagtcgcaatatgctacgttattataatgctataagattggattgattgttaagtccggataccggagagttctcaatggaatcaattaggagatacatcgctcccgccgtcgcactcctgtgcgtattggccgttgcggcacagtcgttgggttgttgcgaaagcgcaaccagcgaagtctccgtcacggggaactcggtcagttcggaatatgcgtccatcgatctttattccgatgaggggctggaaaatccgctgacatcgaatgcattcagcagagggactgcggcatgtaccgcatcgggcggatcgtacacggtcgccgcaggcctgcccgtcgttctgagtcaatcgtcgctgtatctgggttgcaagacgtcatatgcagagacgggtctgacggtcaatgtgagtcttgacgatacggcacatgggtttttcagcagcgtcgtattgaagatagacggtacttcctacaccccttcggaggattcttcggtttttacctgggagttggtctccctcgaatcggggaggggttattccatctccatagaaggggtatccgcaggagggacctattcacaggcaccgtcgttcgacgtgtatttcactctggacaggggatcgtacacctccgtatgcagcgatatgggcaatgtgatattcctgcagagttccgatatcgtcgtcgatgacgaggattatccgaagatagatgtggtcggtcctgagaaagagggtacacacgactcatacgtgatctccaatagcgacggtaaggatagcaatttcatatccgaaggatcgaccagtgcggaggtcgtgttcagcacctcccataagttctgtctctatctttacgtcaaaagcacagggtccagcggaatgtggacgaccacggtgtcagtcgatatcgggagcaccagtccattggagttgaccatcaacaagaataatcccatattcaagaataagaacgaggcatttgcctatgtcggtatcagtagcgggtcactgagcctgttcacaagcctggatggcctaggtgatgggaactggatatccagtgtcggtgatgtgaagatatcctctacttcgaacaatgccaagatagaggtcgccctgaaggtaatattgttctgatgcaatatgccttatgtgtaaaatccaaggatatggaagacgccgtcttcagatttcctggacgagtgtgaacttctgcctgtcccctgcgtcgtccatgtccgagaagtcccctgtaagtctcccgatctttatcagagggaacttccagacgggctttccgtcttctccgctgagcggggtcggaccgtagaatatcaccattgcgttgaccttgggccaccagcagatgtctccggtctcgaacttctccttctcctccccttttacaagaggatccagagggagttcgaaataatacaggcccgatacctggttggcttccgccgagaattcgggcgaggacaggaaccagatcgcactgctgatgtcgctctcgtcgagatccgcgggatattccccgttcctcgtccttatcagcagtttaagcatgcgatccggctccttttgaagtttatcagttcgccttgcgctggaacagtgccctgacctcggcaccggtcttctccagctggagcttggactcgtcgtccatcatggcgtgcaggttcttgagtccgttggcccactcctgcctccactcggtcttgaactcgccggaatcgatctctctgtagatctctttcattcctgcgacagagtccttgttgatgaccttgtccctgcgggtcagtccgccgtatttggcggtgttggagcagacgttccacatgtatgccattccgccctgggtgaccaggtcgatgatgagcttgttctcgtggcagcactcgaagtatgcgacgatcggggggaatccctggtcgacgagggtctggaatccctcctcgatcagcttggagagtcctccgcactcgacggcctgctcgccgaagaggtcggatttggtctcgtagtcgaagttgtcgacctcgaaggttccggcgcgggtgcatccgagtcccttggcgagtgcgagtgcgatcttcttggcgttgccggtcgcatcctggtggacggcgatgagggcggggactccgaatccctcgacgaactgctgcctctccgcatctccgggggccttgggtgccatcatgatgacgtcgacgtccttcggggggacgatgagcttgtaggtgatggcgaaaccgtgggcgaagtcgagggccgcacccttcttcaggttgggctcgacgaactccttgtagatgtcgggctgggtctcgtcgggaaggagcatcaggacgacgtctgcgtccttgacggccttgtccatggtggtgacggtcattcctccgtcctccttggccttcttccaggagggtccgttctccctgactccgatggtgacgtcaaatccggagtcgcggaagctgagagcctgtgcgcgtccctgtgctccgtatccgagaactgcgactttctttcccttgaggacgttcagatccgcgtcctcatcatggtaaatcttggtgtccatgacaataacctctgagcgttgctatatctatgatttataagtaacttatcaggtcacgcggaagccgtctgtgccctatatagaagaaaacgggtcccgtcagaggtgtgcatcgcctctgacggtttttaaaggaccgaggatgggtccctcagaatttgcatctgcccttgacgggtgcgagagcggggttgggcggaagcatggggagggcatcctcctccgggtcgcattttatgtcgacgacgcaggtctcgccgcagtcgaatgcctctttgagggcgtcgtggacctctccggccctttctacgtggatccctttggccttatacgcctgggcgatcatgcagaagtcggggtcgtccccgagttcggtctcggagtacctcttgtcccagaacagtttctgccattgtttgaccatgcccagccatccgttgttgaggaggacgaccaccacgggaagcttctccgccacggcggtggccagttcctggacgaccatctgcagccctccgtcgcctacgacggtcgcgaccttgcagtccggtctggcggccttcgcccctattgcggcaggcaggccgaatcccatggtcccgaaggagccggaggacaggagctgcctgggtctcttgacgtcaaggaagtgcatggcccacatctggttctgccccacatcggtggttatgatggtgtcctcgtcgaagaacgagttcagttccttcatgaccttctgcgggactatgggggaggtgtagtagtcgtagttgcacgtgcatctcttcttccactccttgacctgtctggtccaggggtcgtgtctcgtctctccgccaagggcgtctatcagaagacccagtgccttcttggcatcgcatttgatgtcgacggatgtcctgttggacttcccgaactgggtggcgtctatgtcgatctggatcaccctgcatttcttgctgggttccgtatggggcgagtatgtcctgtcggagaacttggtcccgaccgcgatgatgaggtcggagttctggaacgcctccatggcgcacatcctgccgtgcatgccgagggcccccatgttcagagggtctgcggaggggactatgccgatacccatgaggggggtgacgatcggtgcaccgatcatctgggacagtctcttcacctcgtcggaggcaccggccccgaccgctcctccgcctgcgaagatgacaggtttctggcattccttgatcaacctcacggcatcgggtatgccggagacgtcctcccagggttttttgataccgaagtgctcgttcgtcatcgcctcgtctatctgggcgttgatctggtccacgggaaggtccacatgtacgggcccgggacgtccggatgcggcgatctgccaagcctcgtctatcgcgtggggaagtcttttgacatcggtgacgcggaagttatgcttggtgacggacatcatcaggctgtatgcgtccacttcttggaaggcctcggaaccgaggaccttggaaccgacctgtccggtaagtgccagcataggtatggaatcagcatatgcggtggcgatcccggtgaccatgttggtcgctccgggtccggaggtggaaaggcagaccccggtcttgccagtggcgcgggcgtatccgtcggccgcatgggccgcgcactgctcgtgtcttacgagtacgtgcctgatggaggagtcccttatctcgtcatatatggggatcacggcacctccggggtagccgaacatcgtctcgacatctctgtcctcgagcattttgagcagagctcttgagcctttcatacgaatcgggccagtatcgtcggacgattataaaatattaaacggtgggaatgttatcacagacacgtgacggcatatctcgaagacctgttctctcccggtcgcgggagatatgggtggcccgtatcatcttccgcatatgatgtggatcttgtcgattccatcttggatgaggtggaccccgcatccgtactggatcccctgtgcggcgtcggcaccgtgaatctggcatgttcgtacagaggtgtagggtgtgtgggcttggaaccggatccgttccgtcagacggtggcctccgccaagctcaggatgtatcgggaagatacctacgaggaatgcggttatgcatgtgccagagtatgcgacaacctgttctgggaggatgagaagtacgaggtgcccgatatcccgggggcatatcgtttcggtgcccgtcagaccgatttcctgagaagactccgctaccagataggggaggaaagggacagcgcctcccgggacataatgatgctggcacttttcaggacggtagtatcgatggtccgcgacaccgccgaggagggattcgacgacagcgtgggtctggagcttttcggggattccgtggccgaggtcagggaaggcatcgcccctcccctgtcatccccgtctcgggcatatctatgcgatccacgcgacatcccctatgctctcaggaaggggtacgacctcatcctctcattccttccccatccgtccaagagtccgatgtaccgggaggtcaggtcctgcatgcagtggtccggggcgttccggtcccaggaagacctatgcgatgcggacagacgctccgtgggccgcccaataggtacggtgcggtcctttacggacggctggtctcccaagacgccggtgccgacatccctgacggatacattggacggtctgactccctcggacgtccttttcgtcaggaggtatttcgaggatctggaacatctcttcgtatccttgaaaggggtcatgagggccgacacgtcggcatgtttcttcgtcggcaacgcacagatggacggtgtgacggtctgcgtggacgaggtcattcccgagatcgtcgggagggcagggctcagggtcgaggatgtgaccaaggtgagggtcagggatgcgagacgcgacctggaggattacaggatcgatgtctcccgtgtcgcaggatgatttatacgatgtcacgattccgattcgatggaaatcgatcttcgtgagcccgggcctttggctctgggacttatgcgcatagtcctgggattcatgctggtgtgggcgttcttagataagatgttcggtctgggatttcccagcccttcgtctgcggccgttatcaacggcgggtcccccacggaatattatctgaacgtcttggtggagggtccgttcgaagggatttatcacgctttggccggcaacgccttcgtggatttccttctgttggccggtcttctcgccgtcggctccgccatgatgcttggcatagcatccaaactcgccaccgtcgggtccgtggtcatgatggccctgatgttcaccctcgtcctgcctcccagcgacaatcctttggtagattatcacatcgtgtacatccttgccacactggtcatatattggttcggaggatattcgcatctgggtctggaggacaggtggaaaggcctgtctttggtaaagaggtatcctatcctggagtgaacccttggttacatccaccatcgtccatcctttatatcgttcggaattatgtctaaataataaacagtctgattttatattcatgagtatggacgaagacacaaggatatctacgatagtgtataccgccatagcaatagtcgcggccgtcgccttcaccatcatgttcacctgatggggtgacggaggaaatcccggcgtaatgccgggagaaatcctgttaaaagatcatacccggatgtcatccgggttttttattcacactttatagtggcatcttcccttgacgatcgggaccttggggtccgagaggatcatgggggttatgtcttcctccgggtcggtccggatgtccactatgcacgtggtgtcggaatccatcgccctcttcagggcctccccgatctcggatgccttgtcgacatgtatgccccatgcgccgtagctctcggcgatcttgacgaagtccgggtcggcgttcaacttggtgccgctgtatctcttgtcccagaacagtttctgccactgcctgaccattccgagccatccgttgtccaggaggacgatggtgacggggatgtcttcggcgaccgatgtcgcgagctcctggatgaccatctgcagtcctccgtcgccgacgatggagaggactttggagtccggcttggcgaccttcgccccgatggcggccggcagaccgaaccccatggtcccgaaggatccggaggtgatgaactgtctgggtcttctgatatccagacagtgcatggcccacatctggttctgtccgacgtcggtggtgactatgacgtctccgtccagaagggcgtttatctccttcatcaccctctgagggaggatggggtcggtatcgtagtcgaagtcgcactggcagacttttctgagtttggcgtatctctggtcccactcggaatggatgtccttgtatcctttcagggcatcgaggaggagcagcgtacccttcttcgcatcgcattgtatgttgacgctgggtcttttcgatttcccgaactgggtggcatcgacgtctatctgcacgaccctgcatcccggtgccggcatggtgtgggggttgtaggtcctgtcggagaacttcgttcctatggcgacgatgaggtccgcggactggaacgcgtccagggcacccatcctgccgtgcatacccagaggccccatgttgaggggatggtccgaagggatggcccccagggacatgagggtggtgacgaccggcatgttggtgaattcggccagcctcctgacctcttccgacgcccctgcacctatgacccctcctccgacgagcatgatcggtctttccgcattccttatgaggtcggcggcgtcccttatgccggagatgtcctccgtcggcatcttgaccccccacttcttggtcaggaggtcggagtcgatatcggaattgatctggtcgacgggcatgtctatgtggacgggtcccggtcttccgctctgacatatctcccatccctcgtagatggcatggggcagtctctccgggtcgaggaccctgaagttgtgtttggtgaccggcatcatcaggctgtaggaatcgacctcctggaacgcctccgcccccaggaaactggtcccgacctgtcctgtcagggcgatcatggggatgctgtccgcatatgcggtggcgatcccggtcacgaggttcgtggttccaggtccggaggtggccagacagacgccgggtgtcccggtcgcccttgcgaaaccgtcggccatgtgggccgcgcactgctcgtgcctgacgaggatatgccttacgtcggactcgaggaactcgtcgtagatcgggattacagtcgctcccgggtatccgaagacgttcttcacgcccctgtcctcgagcatcttgagcagcgctttagagcctttcatgtgctaacctcttttggcatcggtatgcgtgcgtgtaataataagtgctcggtcgggagaaggcttcggccaggaaggcggttccgtcatctggcacatacggatgtgccggggatccagttcccctcctcacgtccacgcccgtactatcgcgcgcgaataagacgaaattaatattatatgattggacgctatcgtcgttccagtgagtatttccatggcaaaaataaaggtcggagtcaacggatacggcaccatcgggaagagggtggccaccgcagtcagcaaacaggacgatatggaagtgatcggcatcaccaagacgaggcccaccttcgaggccaagaccgccgccgcagcgggtcttcccatttacgtacctgccgagagcatccctgcattcgagaaggcggggatcgccgttgcaggtaccgtggacgatatgatcgcggccgcagacgtcatcgtcgactgtactcccggcaacgtcggtcccgagtacaaggagaagtatcagaaggcaggtaagaaggccatcttccagggcggggaggagcacggtctcaccggtgtctctttcaattccactgcgaactacaaggattcctgggggatgcagttctcccgtgtcgtcagctgcaacaccaccggtctcctcaggaccctgtcccttctcgacaaggcgtacaagatccagaacgcctatgtgaccatcgtcaggcgtgcggccgatcccggagacagcaagaccgggcccgtcaacggactcgagccctccgtatccttgcccacccaccacggggtcgatgtgaaatccgtcctcccgtggatagacatcaccacgatggccatcaaggcgtccaccaccctgatgcacatccaggcggtcgtcgtgaagctcggcaaggaggtctctaccgacgaggtcctcgacctgttcgcaaaggcgccccgcgtcagactcgtctcctccaaggacggcataaagagcaccaaccaggtcatggaactggcaagggagctcgggcgcgacaggtccgacatgtacgagatctgcatctggtccgacggcgtcaaggtcgtaggggacaccctctactactatcaggccgtccaccaggaggccgatgtgatccccgagaacgtggattgcataaggtcaatgtgcaagctcatggagggtccggaatccgtcgccaagaccaacaaggccctcgggatcgaccactgagggtggaacatggacacatacaacaccctcggcgacatgaattacaggggaaagagggtcctcctcagggtggacatcaactgccccatggacaagaagaccctgaagatcatcaacgactccaggatccgcgccgtcatccccaccatcagggaactcatggggaagaaggcgaaggtcgtcatcctggcacatcagagcaggaagggcaagtgggatttcaccgacctttcccagcatgcggccctgctctctaagaatcttaacgcccctgtgaaatatgtcgatgatgtcctcggcgaagaggccagaaaggccatcttggaggtgggcgacggggaggtcctgcttctcggcaacgtccgtgccatcgattcggagagcgtatcgaagcccatggaggagcatgcgaaaggggagatagtcaccaccctcgcccctctcttcgactattacgtgtgcgacgcattcggtgccgcccacaggtcccagtgttccctggtagggttcgaggacgtcctgccctccgcatccggaaggctgatggccaaagagatgtacgccttgaggaccatcttcaacagtcccagacgcccctccgtcttcattctcggaggtgcgaagttcggggacatcccccacatgatcgagagggtactcagtaacaataccgccgacacagtcatcgtagtgggtcttgcaggtaacgcattcctcatggcaagaggcgtcgatatcggggaggcgtccaaggtgcctctcgccgacgagcttaccgaggagaacttcaagaacgcccaagacgtcatgacgaaatacggtcagaggatccttctgccggtcgatgtcgctgtagagaaggacggtcagaggtcctcggtactcatcggggacatggccaacgcgggagcggccctcgatatcggggacaaatccatagagaccttcaggaaggtcatcgagcagtccaaaaccagtttcatgagcggccctgcgggaatgttcgagaaacccggtttcgaagtcgggaccaaggctatcatgaccgcaatggtcgacagcagcggcctatccgtcctcggaggaggacatacctcggccgccgccgagagattcgacctcgccgactccatgtcctatgtaagtacggggggaggggccctcgagacgttccttctcaaggacccgctgccggtcatcgtcgcactcgagcactcgaaagagaagttcgggaactcccagtgaggccggttcccggaccctcgggggtccgggaatacgggactcagatatatcttacgaaatcttccctggggagtttctccttaggttccccgccgtccgcagggtagcccacaggcattatcgctgcaaggacgtactcctcgggcacacctatcgcctttttgacggcatccgcatcgaagtgccccatccatacgctcccgagtccgagttccgtggcctccagcatcatgaaggacatggctatggagcagtcgacggtcttagagctctgaccgcacatcatctttctgtcattgtctgcatatatcgctattatgacaggggcggtggcgacccatgagtatctgtcgcatgcctttgctatattctccactgtcttcctatcctttatgaagacggcgcggcagcgctgttcgtttctggcggtaggtgcgagtctgcctgcgtcggcgatcctgtctagcttctcctgttcgatatccctgtcggagaacagccttacgcttctgcgggtctttatcgcttcgatgacgtccatgattgcggaaagacctcttcggagaacaatctttccttatgccatgtcgtctttggatctctttctcaggaagcatatgatgtatgccgcagcaattgctaacagagtggccgagaccgcgaaggcggcatacggcacatcgtcctcctcggcagggtcgtggtctccgtcttcctcaggacctaccgcccatgtggagaaatgaggtgtgatgaatacggcgtacgtcttaccgtcttcgaagaccagttccgcctcgccattgtcgacgaggttgccgcttccgtcgatatagaacgagtgtaccggcacatccacgttcccgtcatacggcagtctgacggtgatcgggagtgtgttcccggcgatcgatacgctcagttctatggaatataccgtcttgttcgaaagagcgaccctcacatccttgctcatgtctccgaagtcgtgtatgtgggatactgcgagggttgggtggtcctccaccaatatccctgcagggaatgttatggtccatccggaatatcccgatgcgactatctctccttcgtcatccatgtctcccacggatatggtgacgatgtcactgatggtactctggcacttcgcagtgaatttggcgtagaacacgatattgcatgagactgtcatatccctgtcataccaccgtccggtcgcatcctccgcggtgttccatcccatgaactcgtatgtgaagtcgttcaaggtggacttggaaggatccttaagcggggcaggcatggggctgccgtattccgataccatgcaggtcacgtcatcgccggagacgaatgttatggtgtattccctcagggattggcagaagacggcgtagaaagtcaggtctccggtgacggagggtacgtccgccaaccactcccccttccccgagggatcggtgttccaaccggtaaatgaatacgagtattggacgtctggatcctttaccggtcctctcggagaagatatcttttcgccataggtctgggtcatttcggatacggtctttccttcggagaggaagaccaccagatatgggatgtaggcggggtcgaatatcgcatagaagacgatctcccccgaaaccgtcatgccttcatagtaccaggtacccgtcccgtccttgcaggtgttccaaccgacgaacgagtaagtgtatgtcatatccgcatccttgcagggatcggcgacggcccttatctcggacccatattcctgggtcatgtgtatgatctcgttctcgtgacaataggtcacatcgtattccctcagtacgcccaggaatacggcatacagggagatctcaccggaaacagggaatcctgtaggcggatagtctccggatccgtccttttccatattccagccgatgaacgaatacgagtattggatgtcggagtcctttgtcgggtctttcggaaatgtcgcaccctctccgtatttgcaggtctcttcgaagacaaccgtctcctccgaatagtatctgacagtgtattcccttatcgtcatatcgaacacggcgtagagtacaaggtccccgtccactctgtccgaggcatcgtaccattttccaccgccgtctccgcatgtattccaacctatgaacgaatagatgtattggatgtcctgttccttggatggcggcagagggacgtccaaggattctccgtacgtctgggtcttttcatcgtacagcgtacggtccaaatgatatgatatcgcatagcgtatcggagtgcaatcgaacacggcatatagcgataggtgcccggtcacgatccccgtcccgtcataccattccccggaaccgtcttccttcgaattccatcccgagaatgcgtatgtgtacattacatccgcatccttagacgggctgtcgggaacatgtatcgattctccgtatgtctggacgaactccctgtacaagtcgccgtccgagtaatatccgatagcgtactctatcgcggtccgttcgaatatcgcgtataggatcaggtcttctgtcacggaagacgatccgtcataccatgctccgagaccgtcctcggaggcgttccatcccttgaacgagtacgtgtaccgcaggtccgcatccttggacggggatggagggatatccagaggttctccgtacgtctgggtcttttcaccatacggttgtccgtccgaatgatatccgatagtgtaccttatagggatcttttcgaacaccgcatatatcgacatattccccgtcacaacggaggatccgtcataccattccccggaaccgtcttccttagaattccaccccgagaatgtgtatgtgtacacgacatccgcatccttcgcaggtttaggcgggaggtccagatattcgccgtacgtctggacggattttctgtatagggtgccgtccgaataatacgcgatcgtgtattctatcgcggtccgttcgaatacagcataggcggccatatccccggtgaccgagtcaatcgccgtcatccaatccccggaaccgtcttccttcgaattccatccgatgaacgtataggtgtaccggacgtccttactcttgatgggggattccggcatttccaggttctccccgtacgtctgggtcttttcacaatatggttgtccgtccgaataatacgcgatcgtgtattctatcgcggtccgttcgaatatcgcgtataaggtcaggtcttctgtcacggaagacgatccgtcataccatgcttcgagaccgtcctcggagatgttccatcctttgaacgagtatgtgtatgctacatcggtatcttttgatgggggcggagggaggtccaaaagatccccatatgcctgatccttttcagagtacgggccaccgtttgcatagaatgagatatgataggtgatgagggtcttttcgaacaccgcatatatcgacatgtcccctgtcacaacggaggacccatcgtaccattccccggaaccgtcttccttcgaattccacccagagaatgtgtatgtgtacactacatccgcatccttcgcaggtttaggcgggaggtccagatattcgccgtacgtctgggtcttttcaacatatggttggccgtccgcgaaatacaagatcgtgtattctacagggatcttttcgaacaccgcatatatcgacatgttccctgtcacaacggaggatccatcataccattccccggaaccgtcttccttcgaattccaccctttgaaaggatatgtgtacttgttgtccgaggttttcgacggattgtccgggaggttcaggatatcgccatacacatagttgctgcaagaggcctcttccccgtcgacatagatggacacacaatattctatgggcgtcctatcgaagacggcgtacagtgtgaggggcccggacactgcggatgtcggatcataccaggcacctgtcccatccttttccgtattccatccgacgaatgcatagtcgtattggatatccgaatccttctccgggacccatgtcatcccgagaggggacccgtaaggtctcatgtcttcgaagaacaggctgttttccgaatagtattcgatgaggtattcccgaagggtcttatcgaagaccgcggtgaatacatagtccttatcgatacgcatttccggatcgtagccttcccagcctgcgaatgtatatgtgtatgcctcgtcggtttccttcgaggggtcctcgggggcggataccgtggatccggacgatacggtcacggtcatcaggacctcaccctcggatacgaaggacaccacgggagggccgaatctgaaccatccggagtcggtccaccttatattcccgtccgagtcctctacggtgacggatatgaggtacgcaccgtcctcgaaggtgtggcttgccgatgatatgcttatcccgtacagggtcctggtaatgtcgtagtaatgggattccgtaccgtctccgaagtcccatgtgaccgtgtcggaataatgtatctgtatgttctttcccgaccattccgatacgaaaccggtactgttcccgtagacacgtattgcatcttccggggtggcgccggtcggatccgcatccacggatggggacgagagcagaagcaatgtgatgacggtcaaaaaggagaatatcgtggccgtaacggccgacatccgatgccccagtactttggcaaacatgtccgtccttcgtacttggtcgcgatatgtgcccggcttttttcgatgccggccagataccatattcgttcgaccgattatcgtaggtcgtatgtcgatcaaggtttaaaaatatctggcatgggtggcggaccgtctctgggtgtcgatgtcggaatgcgatgagacggattaaaagaaccgagaatatcggtaaagtgtttgatccatcagaggtggtgccgatcgtcattcttcttttttccagaaaagcatgacgcacatcgcggtgaatgccgcgatggtgacggtgacgaaggcgatggcgcagaggtcctcggttccattgtcgccttctgcggtgacggtggaggaggtgtcggcctcgacgtcatcggacatcatgaggacacctgcggagcaaagtgccactgcggcgataacggccagtgcgaccatggcctttttcctgttttccattttcgtttccatgggatcatccccgcacacgatatgtgcgcgactacggaaggccgactgccatcggccgtccagatgagatgacaactgcatattgacctaaatatctttgttcgcacggtgtctgtaaaacaaacatcgggcccatgtttgttcatgtgggtcaaggtgcgatacgacatttggttgtgtgaagtaaacccctcatttttccgtgcagtcggtggtgttctttttgacttccgtgaaagttcatccctcaatcaatgcaatagtgccacactgatcggcgaccctcgcaataattttgaaacacgcaatcgcgtgatgatcgatgtagactacgccttcagaggcgaccgtcctcatcttatcgacgaatggcaggaggttccttccttgtgggatgccactcgttttaatgtagacaagtacaatgaaaaggggatctatgtgcttacgggctcatctacgcctgtatataaagggatatatcacagcggcgcaggtcgcataggccgtatgcgtatgcgcaccatgtctctttacgagtccggggattccgacggcgcggtaacactatcttcgatattcgacgggacgttttccggaacggatcccaaagaggtctctttggagagacttatatacctgaccgtccgcgggagagggggggggcacaaggcccctcccggttcaatcgtttctcttgcccatccttctgagggcttcctggatctggtcgacgggtttggtgacggccatcctgatgtatccctcgcatgctccgccgaatccggtgcccggggtcacgatgactcctttatcgatcatctcctgggtgaactccatggaggtcttgccgcagtcgaaccacacgtagaaggttcccttgggcatgtcgcactcgtatccgagctcgttgagtccctctacgaggaccttcctcctctcgccgaactcgtccatgttcttctggacggactccttcaggtatccgtcgtcggtgtacatctggagggcggtgatggcggccttctgtatgaagatgggtgctccggagtctatctgccctttgcatttggtcagtccgctgacgagttcctcgttccctacggcgaatccgagtctgaaaccggtcatgcagaatgtcttggagaacgacatgaactcgatggcgtcctttccggcctgcaggacggaaggtgccctgtacccgtcatacgtcatctcgcagtatgcgttgtcgtatgcgaggatggtcttgttcctcttggcccacttgtacacgtccttcacatagtccaggtccgcggtggcgcctgtcgggttgttcgggtagttgatgtacatcagcttggcgtcggtggggcattccttgacgtcgaggagccatttgttctccttcttcagagttatcttgtcacatacggcgttgttgaacagggtggccgctcccgagtacacggggtatccggggttgggggcgatgatcttctccccgtcgttgacgaacgcctgggcgatgttgtagatcccctctttcgaccctatggtcacacagacctcggtgtcggggttgaccttgacgttgaacctcttcttgtagtactctgcgatggcctccctgaggtccttctcccctttcgaggaggagtacttctgattctcgttgacgtccgcggccttcttcatggccctgactatctcgccggggcaggggaggtcggggtcccctattccgaagtcgatcatcttgacgccttcggccttcttctgcgccgccagctgctcgagccttacgaagaggtacggcgggagcttctggagcctttctgcctgcttgaatttcatagacatttgttatcacctcagataatcgatatcgcccgtatagaccagctcggccggcccctccatgaggacgtatccgagtttgctgtcggccgtgatcttcagccatcctccgggcagacgtacgtccaccggggtatcgaagggcacgagaccgttgagggccgctgccacggtggtggcacaggccccggtgccgcatgcgagcgtccatgcggcgcctctttcgtagaccgttatgtgtatcttcccgtctttcacctgtgcgaactcgacattggtcttcttggggaagaacgggtgtttctccaggacgggcccgagtcttctcacgttctcctcgccgatgtcgtcgaaggtgatgaagtgggggttgcccatggagacggcattcgcatggaacttcacgccgtccgcctcgaaaggctggtctatgaatcttccgtcgaagtccaccgggacactcctcgcatcgaggatgggggcacccatgtcgatctgtacgaacgatgtgtactcgtcgtccgggtccttcctcaccttggccttcaggacaccccttccggtcatgatggtgaattcgtccttgtcgacgaggccggtgtccaccgcgtgtttggcgacgcagcggatgccgttgccgcacatctccgcctcggagctgtcggcattgatgatcctcatggttatgtccgtgccctgtccaggtaggatatagaggacgccgtccgcaccgatgccgaaatgacggtcgcagacctgctcgcaccatgccggatccaccgggaccgggtcggtgatgcagtcgaggacgatgaagtcgttcccgatcccatggtacttccagaacttcatctcactgcagcctcttcggaacgatctgatgtctccactgttcatccacctgttctctttcgcggatgagttccgccttaccctcgttgacgaggacctcggcgcacagggggcgggagttgtagttgctgctcatgctgaaaccataggcacccgcgttatagacgaccatgacgtcgccctcctccacatcggggagcaccctgtcgtgtccgaggtagtctcccgtctcgcaaatgggtcctgcgatgtcgtatctcgaggtgcaggccttgccgaacttgcttccgtcctgtatgtaatgataggagtcgtacatggcgggtcttatgagggtgttgaatcccgcatccacgccgacatacttcttcgtgtccgcatccttcacatcggtgcatgtcgtaagcaggacgacggcgtcgcagattatgtatctgccgggttcgagtatgatcttcctgacgtcggtgttctgctcgaacacgtcgcagacctcgctggccatctcgttgaggtccatctcgtcctcgttgggcctgtaggggacgccgatacctccgcctatgtcgacgaactgcagctggatgcctgcctcgccgatctggttgatgagttccgaaaggacctcggcctcctcgatgaaaggctccacatgctgtcctccggagccgatgtgggcatggatgcctatggggttgagtcccaggtcctgggccctgaggtacgtctcgaccacatgttccttcggtatgccgaacttcgcccccttgttcccggtgatgaccttgtctccgtgaccggatcccactccgggtgtgatcctgaacgatacgggtgcgccgggcttgatgcgggcgagcttctccatctcggagacggagtcgaggttgatgaggacgcccgtctcggcgacctccttgagctcctcctcgctgacgaagaccccggtgtacatgatcttctccggggcgaaacccgccttgaggcaggtcctgacctccccgatggagacggcgtcgatcccggcgccctcctgctgcaggatcctgagcaccgctaggttggtgttggccttgcaggcgtagtggacctcggtctccatgtatctcgagaacgcgttgtagacgttgcggtagttctccctcaccctctgttcgtcgactacatagcagggagtgccgaactccttggcgatgtcctcgacgttcatcccggcgaagatcatcttgccgtccttgctgtcgaaatccctcattgtcattgctgtgcctcctcttcgtcgtcctcgacgaacttcttgtggagtatctttatcgtgtccatgacgtgggtcatggggaccacgaagttgagcgagaccgcggaagcgccctcgcttatcatctgtacgttggccttggcatccttgacggctccgaatatgtctccggatacgccgcaggtggtcagaaggctgtccccgacgcagcatatcagcgccacgtccgcggtgacgtctatcctctcgatctcgtccgtgtccaggtcgtcgagcttcttcagggtgttcttcacatcgttgttgtggatcaggatggcgatggtggacagggtggtcgatatggagtagatggcgtcgtcgttctcggatatcttggcgaggatcctcgtgacgatgtccgggcggtatgcgacctccggggagttgatgctgatgatggagaggtcggtcttggcggccacggacctcaggagctcgttcttaggcttcctgaactgggatatcagggtacccttctcgtccggcttgaaggagttcctgaccttcagggggatgtgcttcttcctaacgggctcgatggtcctaggatggaggaccttcgctccgaagtaggcgagttccgcggcttcggtgtagctcatctcgtcgatcttcacggccgcagggacgatcctcgggtccgccgacatgaatccgtcgacgtcggtccatatctcgagcatatccgcgttgagggcgttggcgacgaccgcggcggcgtagtcggacccgcctctgccgaacgtcaggggaagaccatccctgttgaccccgtagaatccggttatcacggggatgcatcccttctgtacatacgggaggacgttgatggccatggccctctcggtctccaggaggtccgcggagccgttcagggggtgtccctcggcgacgatcccgcagtcttcgctggtgagtgcggaggacttgtgtccgagggccctcagcttgtggctcagaaggagggatgagaacctctctccctgggaggtcacattgtccttgtagaacgggctcttcatggcctcctcgtcgtaaaggaggtcgcggaaggcatccatcctaggtctgaattcctcgaggaagagcctgtagtgctcctcgtcgagcatggccttcgccacgctcagatgcttcttctcgaaggtggcgagtgcctcgtccctcttcccgtacacgtcctcgcagaggcccaccaggaagttggtgatccccgacatcgcggaggtcacgacgaccttgtcgccttcggtgttcaatacgatgttagctactctctcaagcgcttcgatggaaccaacggaggttccgccgaacttcattactgtcagcatagtcccaatacctcgatcatgctgtggacttcgccgtcctttctggcggcgacccactttattgactgtatacatccttctgccaacgactcgcgcgatatcgcacggtgcgtcggctccaatatctccatgttcttcgcgaacatcacggtgtggtcgcctacgatgtccccgcccccgaatcggacgctcttccgatggtggcctcgggggacgtaaggtcgacatatacgtcgcagtccttcagtacgcggtccaatccgtcgggtccgaccgcggccatcccatggatggattcgccttcgtgacctcctccggaagagacgacggtcccggcgagctccagttccggatcgtctgcgacgaggtcgcatacgatcgaacccagcttgccggtggccctcgccaccgcgacccttatgaccaccctatcacagtccgtattgttccaatatggggttcaggatggcccttcccttgtccgagatcggtgtcagggggagtctgaggaagtcgaccccgaatcccatcctggacatgatgtatttgatgggtatggggttcgattcgcagaatacgcccttgaacagcggaagcatcctctcgtggatctccttcgccttgcccatctccccatccttcaggaagtccaccatctgggagacctccttggggcagcagttggatacgacggagaacaccccgtcccctccagcacccatcacgtcgtaggtcatggagtcgtcgccggagaggacgacgaaatcctccttcttgttgtcgatgacggccttgacctgtccgaggtcgccggacgcctccttcacccctacgatgttgggtatgtcggcgagacgggcctcggtctcggcggtgatgttgagaccggtccttccaggcacattgtacactatcaccgggaccccggccgcctcggcgatcgcctcgtagtgcttcacgatgccttcctgggtgggcttgttgtaatacggggatatggaaagtatggcgtcggcacccatgtcggccgcctccatggagaggtctatggcctccctggtacagttgctgccggctcccgcgaccaccttggccttcttcgcctggtctatgacgatctcgatgacctgcaggtgctcctcccttccgagacatgccgcctccccggtggatccgcaggggagcagcatatccactccgttctcctcctggaagtccacgagccgcctgagggcctcctcgtcgatggtcccgtccctcttgaacggggtgataagtgcggttccggttcctgtaaattctctgctcttggaatgcattttcaattctctccgaaatgctccttcaggatgaggcgggtgcgggtgctgaggacgttgtcgtatctcctgaccctctcgatgatctcgttgaggctctgggacgactccacgtcgacgatggctattatgtcctggtctccggtgacttcgaagacctcggtcacgccgtcatactcggacagcttcctggctatctcctcggtgtcggtgttgacgtctatacgtacctccacgagcgccttcacgttcttcgaactggtcttgatcgtgaacccgcggattataccgtcctcggtcatcttgtggaccctgctgcggacggtcccctctgagacgccgagcttctcggctatctcgacgtaggggcatcttgaatcctttttcatgatttcgaggatgcgtttgtctaggttgtctatcaattcggcccgccttcccttctaatacgcacgtgtagtgcgcatccctatataacaataatgaatggaatacgataaacttagaaaaacatctattgaaaaaagaaaaaggtaagaggttttacgattttcgaggttcaggattcggtgttcctcttgttgtactcgttggagcccttgtcgttcttcgcctcggcctcggtgacgcgcacttcgtcgatggtgatcctgtcgtagtcgaactggatgccgttcgccatgaacgcctccaccatggcctgcctgatatgtccgcgggccgtgtagctggtgttgatgtcgtcgaagtacattcccatcttgatggttatgttggtgttgccgaggttctcgaccctggtgtacgggcgcccatagctgccgtccgtgatcacatgggggttgctgcaggcgacgtcctgcataatctgacgggccttgttgatgtcctgcccgtatgcgacgtccatggtgagatataccttcgtgacgagggtctcgccggtgatgttctggatcttgctggtctcgatcgtgctgttaggcatgatgttgacgtcggtgttgtcccagttctccaactcggtgttcatgacgttgaccttcctcaccttgtagatggtggagtcggatccgatgcggataaggtcgcccttcttgaacgggcgggtggccaggatgacgagtcctgcgaagaactgcttcagcacgtcctgtgcacccattgatattcccagagatacgattccggcggaggtgatgatggccgcgaggtcgaagccgaggaagttcatgaccacaatgacggctacgactgcgatggcgatctccccgatgtacatgaacagcggacgaaggctctggagttcctccttgtggagctcggccttctcggacatgtggcggaggatgatgtcgactatgaccttgtacaggtgccagccgactatgaccccgactatggcgtatgttacggagaacaccctgttggctatatcgatgagggattcgtccgtaccgaggatgcggaggacttctccgaacgcccatattatgatgatggcgtggcacagctggtagagggtcttcttgatggcgttcctttccgggtcgtcctttctggtgatgagtcttgcgcagacggggacgaccacgatcacgatggcgtatccgatggcgagaagtgccaggaacgatacgatggccgtgaaccatacgttgccgagtattccgtcgaactcgttcgggaacaggccgaggaacttgttgtacttgtcggaggtaaggtttgatgtgactttgatgttgatggggaatgatccctcgtcaccgtcgatgtttacgctgttggcggttattgtaacctcaagggcgtaagttccttgatgagcatactcgccagcacttaccgttatgtctatctgggcctccccaccatgtgccagtgggatgtagttcgtatctgattttgcagttatcttggattcgttgcaaaatacgcttgccctgattttgacatcttcagagtattcgctgtataagaagaatgtcagagtggtggttcctccggccgaaactgtcagggactcagtcgcatcatagtagtattttatctgagttcctggaatatccgtagtgactgctgacgaatcgtccgattctaacggcaccgcggctacagttagcatggccaataccgctactgcggctaggaagaatttggtcctgcttgacttcatgctaattgtaatcaggctcttttatttattattacacagtggcataataacaaggggttgatgaagtttgacggatgtcgtagtgttggttgacattatcctcgtactcctggtcatgctgtccgcatcccgcagcgatattgcgaagagggaggtctccgaccgccactggcagatcctagcggtatccggccccgtactgttcttcatatattgcgtatgttccgagggcctccgctgggagtttgccgccaacctgctgggtatgttgtgtgcggccctttgtttcaccgcaggggatgctagacaggacgtcgtcatgggggccgtatccatcgtcatggtcgccatggtgttggtattcggggacggagggtccctgtcgaacgcaggggtggccgcacaggtcatggtgttcgcatactttctgctgtatatgctcggggtcctgaggggaggggcggatgccaaatgcctcatcgccctgagcgtgtcgctccccatctattacgacgtctggaacatcccactggtcgatagtgcgggtccggcatcgtatatattcgtcccttccctgtccatactgctgttcggcgccatggttgcggcgctgtggtgtgtagggtggtgcctgctgaggatggatgggaaaaagcgcaggggactctcctgtgtgatggacattggttctgcggagaaggcgttcgtctggcccctcgaggatgtgaaggaaggaaagaaggtccgcaccggcacatgctcggacgaggatatgccggaagtgtatgcaaggctccgcgaccatggggaggccgaggtggaggtatcttacatgataccgttcatagcgccgctgaccgtcgcgacggttttcacattggtcgtaggaaacccactgttccttatctgatgatgttcagcctgtgcttgcagaatgcgcaacggtcgccgtccaggccgattatgtcgaccatgtagcccgttctcttgattaccgccgccccgcattccggacagtatgtgtcagatgcatcgtcatggaggatgttgcccacatatgcgtagttcaatccgctgtcctccgccatgccctggaacctgaggagggtgtccacaggggtcatcggcgtggtcatcatgttgtaatccgggtggaatctggagaaatgtactggtacgtcgggggacaggctgtccctgacccattccacgaatttcgccacctccccggtactgtcgttctgccccggtatgaccagataggtgagttccagatggacgccttgttcgaagacgacctcgcaggacctcttgacatcctccagctttcctccgcaaagcctgttgtagaatctgtcgttgaatgccttgacgtctatgttcatggcatccgatacggagcagagctccttcagaggttcttcgcagacgtatccgttggtcaccagggcgatcttcaggtcggggtcgcactcgtggacgtccatgatgtactcgaaccagatgctgggttcgttgtaggtgaatgcgatctggtcgaaattctgctgtctgcagaacgccgctatgtcctcggccgatttgaacgtggtacgtttcttgccgataggggacatggagatggagtagttctgacagtattcgcagtggaggttgcatccgacggaccccacggagaatatcctggtgcccggcctgtagtggtagaacggcttcttctctatcgggtccacggccatggacgatatcctgccgtagttgtatgccaccagtttcccgttaaccgccttgcgggcggtacagcggccgaaaccttccggctgtatgcggcagcggtgggggcaaaggtcgcatgccatgatattgccgtcttctatgtgccagtgtctggcctcgatgttggggttaataaatgccatcctgcatctccgacctttgttccccgtcgcagaggtacggggcggagtcgttggtcacgacacctattatggagaacgcgacccctgcgtcgtacagatcctgtatcttggatttgtcgaacgtgaagaggagttcgtagtcccctccccatctcacgacggtctctttgacgtctttacggcagagggcgcagatctcctccacctcttcgccgataggcaggaactcccactcgatctccattccaacatgggatctggcacatatcgtacggcacgcattcccgagaccgtccgacaggtccatgcaggaagataccgcaccggaggcggccattttgatcccctcctcccatctgggtacaggaaccgtcagcgagaatatgctgtcctcgtactccgtatggccgttctccagtgccaggaatccggcggcggcgtttccgagactgccggtcacagccacgatgtctcccggctgggcaccgtctctggtcatgggtttcctgccttcgaggttcccgagcgcggtggacgagacgatcccgggccccggctttgtatccccgccgacgacctccgtcttacagaactcacaacactggtcgataccgctggctatgtcgaggaggtccgactcctccatatcgcccggcatactcatggccgtcaggagtcctacggggcgggcacccatcgccgcaaggtcgctgaaattcacagccgcggccgtccacccgaattgttcccaactcatattgggggtcttgtgcctttccaccgatacggcgtcggtggtcgctacgacccttccgtcggagagtccgccgattacggcggcatcgtccccgggaccgatgactgtatcctccgaccttctgcggaagatcgagcgcatatgctctatcagcatcctctctccgctctcatccagggtcgccatgtcttccgtatctgcacgctgactttaaagttggtcctcgggctcacactgtccgatgatcagacctgcgatcattcaccaggtaagggctacgtacgcggtcctcgcgtcgtacggcgtcatccttcccgttctgtttgaatccctctgtgccttattccttatcgccatccgaccacttgttcccgggtggcctcccccgcagattggaactcgttggggggagtacctccctttcttcgacagacggccgcttcgttccgggcggatcttgaattcatgatggtttttccgatatcccatgtgcatgagaaatgtaggtattgaaatagagccagcagttgtaaaaaagaatttgcgatatgcttacggtcccgacgcaggcggatgcggactctcgatattcgtcggaatcgggaggtgtctttcgaaagggatcgcggtctcggggtcgctgaacgcaatatacggagggagtccggtgtcggtcgtatatgtgtgttgacctatgtagtccagaatcggacttatgcacggatatatctggatatataggttatataggcggtgtgcaaaaacaatccaaaatatcggatcgcacaagtcatattaatcatgttccaacacacttatttgtattatctgggtcatttatcgtctgcttttgataatgtcatcatatggattcaaaacggattatggccgtatgtatgattctgcttatcgcaggatcgtgtttcattactatggcagaggccccacgtgttcatgggtcggagtccatctcttcagtttcgaatcattcagaatttggaatggagatgatctcttcagatgatcaaaagtacaccatacctattcttaattccaaacaagatccttatccggtctctgacataaaggggattgtcgaaggaatacctgaaaacgccgccgtcatcgtggatgatctgtggtatgattcttatggcacacaggtggccggggaggtactttcagaattgtattggaggggcaacgtagttgcatccatgaccgacataggtacattcctggacaattcctctttcgaattcgcagcctatgtcgaatcggcagacctatacgcggcatatcatgatccggttacgggtaggaattccttctgtaacatcgtttcaggttccgaggacctatctatggaaaaattcagggaatgggtacgggagtccatatcacatgacgctgaagaacaaggcgtcatgtcgaacgattgcagtcagacatgtgcgcagtggggcgaagagaattctagctacctgtataggcactatgatggatacgggtggatgaatgtcaatacggattattttgctttgaacgaagacaaccatcaatacaactatttctacacccattattgtatacaaagcgttcctgacgatggctgcagcactgcggatctgaatgtctatacaaaactcggtgaggaatgcaggatcctggattatgctccgacgacaagttccggaacatcgaccgcaggggtcgatctgggcgtaagttccgatggagtgatctctgccaacatatcttggtcgtattccgtaagtgatgtcgaggtgatcgacagatcgaatttcggaacaaacgagttcaggatcaaccatgatctgaatgaagattccaatgtcggttccaatacattcatggcagaacctggaaaaatcgtccgtatcgactgcagtgccggtaatctgagcggatcatacatcggtacggaccactatgagataaatttctgtaaaaaggtccataagtggccgttctctaccaaaaaagaatatactggattcagcgaggacctcaaagtctattgttattcggatagacatgacgtatcgatatacctcaatggggcagaggcatatgcgccagggggaattccggatgtgccagcagatgaattcttttcgaaaagagtcagtgatggcggttatgtggaagtcgaagactacggctatctgaagaacgggtacatcatggcaggtttttcaacaaatatgagtgccgtaacgccggaattcatacgcggcagtgcagtgaagatcgagtcggatatggatctgtatatgatttgggtgagagaatgacgttgaacgatctaaggcatcatctggtcgatatgagacataccataggtgcattcgcatccgtcattatcctttcggggttattgatgttcgttgcaggtcaggtcgtcttcgtattggtcaagggctcctccatggggagttatgacgggataagtccgttgatattcgattactatgatcaagcgctcataaacgccgtatggctgacgatcgtcgcaatcggttttctcatgtgggtatgggtgcttgcagaggggtacatcctcgccaggaagggggaaaattaagtacaacagctcccaaaatcattaaccgccgtccgatcgggccggggccccatcctcgagtaatgggtcaggacgactgggcggctacgtcccgtccccacggcttcgattttactctcgagggaatgcggcgtcatcccagtccaatggacatagccagatctcgatattttttcgtatcgtgatcctattggacatgaggttctatgtattaggaaccggccccgatacccacctaagcctttccgtttcgtatttttccggaacatatcggatcccggacccgtccaacttgggatgggtgtgtccatcgcatcggacttcatgcgttttcagatccaatatcggtatgggtgccacactcccgtcttctcttcccatatatttaagaagaaaaaagagggataacggctcagattgaaatgatagtggacgttaagtacggcaaggacggcgtacagaagatagagatcccggagaagaactacatcgggacctattctcccaacgacgtcgtctgcggtgatcccgaccaagtcatcaacgaatccctcgacgcaccgatcggaggagcacctatcgacgagttcctcaagggcgggaaggacatagtcttcatcgtcaacgacggtacccgtcccacccctacggccaaggtgctcgacgccctctccgagaggatgggcctccgtatcgccagatatcttatcgccaccggtacccacaggggtccgaccgaagaggagtacaggaacatattcggatcccatctcgaggagctcagggacaggatcgtcgtccacgatgccaagcagtccgagtgcgtgaacctcggaacgtccaagaacggtactccgatggaggtcaacaagatagccgtcgacgccgacaggctcgtcataataacctctgtggaaccccactacttcgccggatggaccgggggaaggaagtccttcctccccggagtggcatcctatgccaccgtcgaggccaaccacaggatggccgtcggtatggatgcacaggccctcaaactcgaggggaaccccgtccatgaggatatgatggacgccctggaggtcgtcaaggggaagaagatattctccatccagatcgtgatggaccgccatcagaacatctacaaggtcgcttccggagaactcaatcccgctttcgatcaggccgtcaaatggggcgaggaggtgttcgtagtccccgtgccggagaaggcggatgtcgtgatctccgtagccccttacccgatggatgtggacctctaccagtcgcagaaggccctcgataacgggaaatgggccctgaaggagggagggaccatcatcatggtgtccaaatgcagggagggagtcgggcacgacggcttcctcaaactcctttccacgtccaccgaccccaaggtcgtcatagagaacataaagaaaggttacaagctcggataccacaaggccgccaagatggcggagatcgccacatgggccaacatctgggccgtcaccgacctcgacgacgccatcataaagagtgccaacatgacccccaagaagtccgtggccgaggccctgaaggatgcgttggacgccaatcccgatgcaagggtaatggtcctggccgacgggagcgtcaccataccccgccccaaggaggaatgaaaacaatgagcgataccgtattcaccgccgataagatagacaagatcagggcggccctctccacctgcacgatgtgcggtttctgcaagagcgtatgcccctcgttcaaagcgatcaactgggataccgacctctccaggggacgtatcgtcatgacctacggtctttccgtgggacagctcgagcccgacgattccgtcgtgaagtcgatgtatacctgtaccacctgtgcggattgtgtcaggagatgcccgtccaaggtggacatcgtcgacatcatcgagctctgcagggccgacctcgtggccaacggtcacatcctgcccaagcacaagtctatgtgcgagagcatcgtcaagtaccacaacccgttcgcggagaagaagtctgtcgccgaggtgatgaaggactggggatatgagccccatcctgctcccgtcgcatatttcgccggatgtactgcgacctacagggccgtcaagaccgcgaaatcgtccctttctatcctcaagaagctgggagtggacttcaccaccttggacgagatctgctgcggatccgtcatgggcagggtcggctggtccgagaaggaccttgtggagatctacaagaggaacgtcgacgccatcaaggccctgggagtcaagaccctcgtcctctcctgtgccgggtgctacaggatgttcaagaaggagtatccgaagcatgtggaggtccccttcgaggtcctccatatgacggagttcctggccagacagaagctcgacctctcgcctctcggagacgtcaaggtcacctaccacgacccctgccacctcggcaggcactgcgaggtttacgagcctcccagacaggtgatcgcccagttccccggcgtggatttccaggagatgaagtacaacaggcagttcagccattgctgcggaggcgggggaggggtccgtgcggcctatcccgaagagtccgccaagatcgcggatacccgtctcgacgaggcggatttcgccgacgtcatcatcaccacctgcccgttctgcgtcaccaacctgggtgcacaggccaaggacagggacgtcaaggtcgtagacctcgtggaactcgtggacgagcatcttcaatgagggctaccgacttcttcaggggcgggaggtcccgccccttcataatgggggtactgaacgtgacccccgactccttctcggacggaggtctttggaattctcccgacagggctctggcacatgcctgcgatatggtcgatgcaggtgccgacatgatagacataggtgccgaatccacccgtccgggagcggacaagatctctgcggaggaggaactccgcaggctaatgcccatcctgtccgaggtgatcccgtcgttggatgtgccagtgtccgtagatacgtacaaagcgtccgtcgcagaggccgccgtggaggccggggtttccataataaacgacgtctggggactctcggatccggagatggctccgacggcggcacgtctggacgtgcctctggtcataatgagttccttcgggagttccaagacgttcaagacggatttcatccagggtaatatccttcgctatgcaggggacttcattctggaaaagatagatctggcacatggcgccggtgtaaaggatcacaacataatcaccgatcccgggataggtttcgggacgacccatgaacagagtatggagatccttcgcaacagttcgtatttctctttcggaggaaaatacccggtcctcgttgggccgtctaggaaaagattcctgtctgccggattcccaggcatggaccgggatgatgccaccgccgaagcctgcgcggtcgcaggctccagcggggccgatatattaagggtccacgacgtggcctgcaccgtgcgcaggctatcgtgattcagatttcggcgtaatcgttcttctttctttcagtcgcactcttgtgcttcttgtatgctccgatatattccccgatggggaccagtacggatacgagcactatgaatgtggcgaacttggcaagaccctttatgccgatctctatgctgtcgagaccctgaccttcggctatgctgggtatctcgatgctggtggcggcggagtccagcaggacggtcagccacagggcgatcgcgacgcatttcaggacgcctatgagcagtttcgccttgcttccggatccgaagtagctgctcagattgaccagtatgaggatgggcaggtaggccaccagggagttgaatatgaatcctccgggctgcagcatctccatcatggattcgttcatgctgaacatgttgtctattgttccggactccatgtatgatgcaagcatcagggtgagaaggatgatcaccacgtattccagcaacgatatgaggatcttcttggccaccctcgccttgctgttcagatacggggcatcgttcttcttgatgatcttcacagcttcttccgatgtcatgcactccctccgtagaacgccttgatcatctcttcgaacgattcggcctgtgccttcgttatggtgcagctgccggacgaggccccctgataggtgagggtgagttcctcgttatcctcgaaatactccttgaagtacgtctccatggcgccgtaggccgtatcggtcacgccgtccgctgtgaatttcaccgtcttcccgtcgtcggagatgttgaggctgaaactcacgtcttcgcatccggctatcttgatcgtgcagtttccgctggagtcacacacgctcttcgcgacattcgagatatctttggtgaacgacgatccctcggggatgtcgatggtcatggtggcggaattgtccgttttcgtcatccccacatttcctttgaatcccatgtcaactctcagattgaggccgaggtcgatgagtttctcgtcctggaattccaggtaggagaagtgcagcttggccaatatgggtgtctttatcactccgtccgaggaattggccgcaaggctggcaaggacgacgtatgcggggatcgttatgttcgcagactcggtcgtggtgacgctcttagctgtcaccgtacccacatcgatctttccgagagagtacttctgacctccggaatccagagacagttcgatgtatacgtcctcgatgtccgagggcatcttggaatcgatgatgaatttctgggtcgatatggttacatccatgccgctgtaggagatcgtattctccgtcgattcgtcggcttttatgtcgacgggcggatattcggtcgggattgccgtggtgaacagaccatagcaacatcctactatgatcgccaccgcgatgatctcagtgaccagtttgggtccgttcatgaacaatctaatcgcatgtcgtattataatagtgcgtatggtcggtcatgtatggttgagaaatccttcagaagacatatcctgcaacgaggatgacggcggcacctacgacggcggtgacggccatggcggtatcacggaccttctccttcctgattctcttctggtcgttctcgtagcactccatcgagcagtatgcctgttcgaacgggacggcacatccgcagtatctgcaatggtcgtggtcgggaaggtccaccatggatgctacatgtaatctattccttttaaaacttgaagtatgatttgcaagacatgggtgtcgaagatccctctggacaggacggcgacggtattccttcatggtatgacggcaaccgtgtcgccaaggcccgcgttcttctcgtaggtgccggatctctcggggaggagacggccctggccctgtacggccgcgggttccgccgcgtgctgatggtcgaccccgggaccgtgggcagagacgacatcggacatctggcacttgtcggcgaggaggatgtcggaggattccgttccgaggtgtcggccaagaatatggcggcatccacttcatgtcccggcttcacataccatgtgggacgcgtccgtgaattggaagggtggaacttcgaggtgatcgtcggttgtacaggtgacacgaggaccagattgttcgtcaacggccgtgcccgcctgtaccatattccttatgtggatacggcggtcgacggtaaaagagggaagatccagaccgtactcgcggcaggtccctgtgcggaatgcggcatgaaccgtttccgtacaagagggctgaatgccagaccgtccttcgaacaaccggctccgagaagaagggtcgatccgcagacggcgaaggtcgtggcatcgatggcctcggaggaagcccttcgcatagcatgcggaagacaggatctttgcaccaaaggcgtcgtctattacgacggtgcggacgggtccgttcgcacgatatctctgaacgtggatcccagatgttctaatcacgagggagagagatggaaacagacattgaagtcgttaatgcaagggacgggacgtctctgagagtggatatgtcggatgactgtacggtggattccgtcagaaagatcgtggaggaatattggggtgagcgtgctggcacatatctcctgaggaatgggacggacataatatccgacgatacccccctggtcggcggggaaacgtattacgtagtcccgatgccatcggtgtcccgatgagagacattcccgagcgtacccgcatatccaaggcggagcttttcgtcacagacatgatgttcgatatgatcgccgacctgtccgatgatgcgtactacagggagacggatgccgaagggctcatcgccggtctgttctaccgcgacgtcctgggggtctatggggttgcatcgggcctgatcccggccatgtccgggatccatgaggccatagggtggttcagaacatcccccgacggcacctcgatgtcccagagggacatggccaggcatgtgggtcttttcggtcgggacaaggccttcgcgataatggtggacaatgtggcctcgtctttcgcaatatatgcggtggaggacgggatacccagaaaagtgcaggccgccgttctagaaggttgatcatacccagatggcatgatgcgaccgcatcttgtcttcggatatgcctttgcgcttcataaggacgggtatcatgcagtcgaagaacatgagggcggtgtcctcgaacagggtacccaacggtgccagttccgcagtatccccgtcctcggccgggtctatgacgatgcacgtgtccgcggctttcgccagatcgcacttccggttggatgtgacgcagacgacgtgggagccgatcctctttgcgatctgtgcggtcttcgtgaccgacatggtcctcccggtgttggatatcagaatgaccaggtcgcccttgccgatgatcggggtcgtcatgtccccgacgaaatacacatggagacccagttgtacgaggcgtaccgcaaacatctgtcccaccagacccgatcttccggcaccgaagatgaatatgcggttgctggatattatcaggtcggcaaggcggtcgcggtccacgtcggagatacgttcgagggcctccttgatgtgaccctcgaggtaatcaatggtctccaaggacttccctcctttccttttcaggcctcgggttcgtcgttggggtccgccggggcgagtgtcccgttggcgatggccgccgcctcgtcggacttcttcttgtccttgaggtatttggccgccttcttggagagtaccctctccgtgagggtcctcatgtatacggcatcatgttccagaagaggggaggaagagatcagggttatctccggcatcatgtccgcaaggcattctgcgagcctttcgaacttcaggtcacctttcttcagaggggtgagccatttctcgttcccttcggtgtcgaactccacattggagaacgaggagtataccccgtccttggagtaggggacgaactgggctatgaggtcggcgaagtccgtggatgttatgagggaccctttggtcctggactgatactgtgcgaagttgaggacggggacgacggcccctttgaaggaatcgcagaggtccaggacctggtccagcgaaccccatacgtcctgctgtccggtgacctccacccccagtttgggcttcagtttcatggatttccaccatctcatgagctcgctgaggttgtccatcatgttggcctcggtgtcctccctgcttctcttagggtcgtaggggccgaggttggtgaccacaacgttcccgccgagggcgttgaggaccaccccgccgttcctcagggtgttgaaacactgcatcgagagtgtctccggaggcatctccgcatattcgtcgtcctcgggcatctcgtacgagtcgtcgtagagctcccctccgaggtccatgtaatagggggtgtggagcgatagtgccacatcgtgcctcctggccatgttgccgagggcatacaggtcgttgaagcagtatgcgatccccgatgccatctccagaaggttgtcctcctcgtcgatgacgacgtcggggtcatagatgatgtcatcctcccccttgtctatcccgatcacgaagccggactctccgtcgagctctctgatggatttccctacttcctcgtcctcgtcaggggcgcggaagaatgtcttcggtctgaccatctgtatttcgagagcggtgagggcgaggttatgaacatcctctattccgtccttcagggtgcgtcctttgcaggacagcgggataccggcgggtccgtatcttatcatggacaatcactgatggcccatcaacaaggattaaagtattaaaccttagccacaccgccgaggccaaggttcccctatctttctataaaataaagaaggaaagagggacgggatagatttataagcaggaccagcatacgagcggtctacccaatgtcgggagagtcagaaaatgagcagaacttgctacaaatctaacccccagcttgtcgccctgatcgcagatctgaaggcgaagactagggagaacgagaaggctgctatctggcgagacatcgcgctccggctcgaagcacccagcagggtgtgggccgaggcgaacctcagcaagatacagaaatacgcaaaggacggagagaccattatcgtacccggtaaggtcctcgccgccggtgagatcgacaagaaggtcaccgttgccgcctacagcttctcagccaaggccgcagcagccatcgtcgccgccggaggaaagaccatgaccatcagggagctgatggaagagaaccctcagggctctaaagtcaggatcatggggtgaattgtaatggttaccgttatcgatggaaaaggcctcatttacggaaggcttgccagcaacgtcgccgaaatgatcatggccggggaggaggtagtcgtcctcaacgccgagcagatcatcatcaccggtgagaggtcggagatccttaaggacttcaagaacaaggtcgaccgcggagatgtctccaagaggaaaggaccgttctacccccgccgctccgatctgctgttcaagagatgcgtcaggggaatgatcccctggatgtccagcagcggaagggacgccttcaggcgccttcacgtcttcgtcggtgcccccaagcagttcgaggattcgaacaaggtcaggcccgaagaggctgacagggcagtcacatgcaaatacgtcaccctgggagagatctctgagttccttgggtctaaggtgagatgattcaaatggacgcagtcaacaccagtggaaagaggaagaccgcgatcgcaagggcggtcgtcaaagagggaaccggaaaggttgtcgtcaacaagacccccatcgcgatctacagccccgagcttgcaaggctcaagatcgaggagcccctccagctcgtccccgagaaggccgcaaaggtcgacatctccgttaccgtacagggcggaggagtcatgggacaggcggccgcagtcaggaccgctatcgcaaggggactcgtcgacttctacaaggacgacgagctcgaagctctcttcagggcatacgacaggaccctcatcatcaacgatgacaggaggaaactgcccaagaagcccctgggacgcggtgcccgtgccaagaagcagaagtcctaccgttgagatgatatcatgataataccggtgagatgtttcacatgcggaaaggtcgtgggctctgcctaccccgagtacgtcaagcgcgtgaagatgggcgaggaacctcagaaggtcctcgatgatctgggattcgagagatactgctgccgcaggatgatcgtgtcccacgcagacctcatcggcgagatcgctcagctcggatgagcttctggcacccaaaactttttaaactaaactaattaataccctattaagtgggcccttggggtagcttggtatccttcatgcttggggtgcatgtgaccccggttcaaatccgagggggcccaccaacttatcatccaagtctttgttcagcggtttttcctgcaaacataggtcctgttgcgatcttcatatttcccataccccatcgttatcgacataaggcctccgaccggcgccgggagcggttattttcgatagggtggcgttttccagtaagtgcattacaatccgggtatgcatgccataccacatgtgtgttcccggaagaggtgttgttttaaccatggtcggattgtaacatctgtattccgtaatacggagtatgggaagtcaagtgaaatgagactcgagaacaaggtggcggtcataacaggtgcatcgcgtgggatagggttctccatagcccgtgcattcctcagagagggctccaaagtcgctctttgcggtagcaggcaggagtctgcggacaaagccgtagccaaactgaagacggaattccccgatgcagacatagccggattcggattcgatgtcaacgataccgtacaggtcaaggacatggtggagaaggtcgtcacaaagtgggggcgcatagacgtattggtcaacaatgccggagtgacgtccaccaagagcatgctcgacatgaccgatgaggatttcacttcggtcattgacataaatctcgtagggcccttcaagatcaccagggaggtcgcacgtgtcatgaaggataacggcggcggaagtatcatcaatacaagttcgatggtcgggacgtatggggggaagatgcagaccgcctactcctcttccaagttcggtatcaacggtctcacgaagtcctgtgctaaggagctgggacaatatggtatacgcgtgaacgccgtcgcaccgggggcggtcgccacagacatggccaaggaattcacggatgagaggatgagacagttcctgtctatgatgacccctctgggtcgtatggccgaacctgacgagcttgccggggcctacgtttacctggcatccgatgagtcttccttcaccacgggaacgatcataaacgtggatggcggcatagtgatgtgatcgcgcccgggcatcctggttgaaacttcttgatctctgttccggccgttatgcggtcggacggatttttataataaaaaggaaagggaaggtgcctttgcggcaccttcgttttcaatcgctcttacgttcttcctcaggggatgtgccgtcggatccgagagaggcgacagactgttcctgggcagaggaggagacggccgtggtggcagcggacacaggctcatcgtcgaagtggatctccctgggcatctcgggggccctctgggccttgaagaagatgccgattatgatgaggcatgccatcatcaccgctccgcacaggaatgcgaagtctatgctgttcgcgaacgacagcaggatgttgttcatatcggcgaagatcgagaggtcgatggggtccagggatccgttaatgacattctggacggcattggccaggtcgtcaaggactcccgttccgtgctggatgtgctcgtatgtgaactcgcttacatgattcatcagttcgactccgagcctgttcccgatcagtgtagcgaagacggccgttccgacggtggtaccgatggatctgatgacgttgacggcggatgtggtcatacccatctccgagggctcggaactgttctggacggcgaccatgataacggacatcatgcatccgagaccgattccgaagacgaacaggcagatggcgtaatagctgagctccgtgcccacggtcatcccgctgaacatatacagtcccagcgcagtgattatggggccgatgatgagccagaacttgtatccggtcttattcaccagatttccgctgagcatggatgtgatcatcattcctgccacgagtgccagggagtactctcctgcctccagggtgttgaggccgaggatggagatggcgaacatggacgaatacatcatggcgcccatcatggccagtccgaagacgaacatgaatatgcatgcgagtatgacggtcttgttgtggacgaggtggggtgcgaggataggctcggcggccttcctctcgacggtcacgaagagcacgatcatcgcaagggcgatggcgatcatgacgaacgactcggcgctcacccagtcgaacttgcttccggcccactcgaagaacagcaggatgtcgagaagcatgatggacaggaatgcgatacccttcacatcgattatgggcttctcgtcgtagacgggggtggggaacttcttgatggtcagggtgtatgctacgagagccatcgggatgttgatgtagaagatccagtgccagctgatgtattcggttatgtatcctccaatgaggggcccgataccgcttccgataccgaagaccgctccgaggataccctgcatcctggccctgtccttgggggagtataggtcggccacagccgcggtggctacagggatcaggatacctcctccgagaccctgtatggcgcggcatgcgatcagcatctccatgctggtggacatccctgcgaatatggatcccacgacgaagagggtgagtccgatgaggaacaggggtttccttccatagaggtcggatagttttcccgatatcgggatcatgatggtctcgcacagcatatatgcggtgaccatccaagagtagaggcttgttccgttgaggtcttcggcgatgaccggaccgcaggttccgacgatagttccgtcgaaacacgcaacaagcatcgcgaacgaaagtccgaccattatcatgttccggaccttcggatcgatattcttgtaggttatttgttcaactgccatatggagataggcgaaataaaccgtatatttaatcgtttaccaataaactattttgatgtttatgttcctgttggattgtttttcaaaaaactattaatacggctgtactgaaaatatttgcatttcaaatgagccagacatttattttttgcaagtaatatcgcaaatgtcccgaagtccggagaggggtcgtccttcacacgtactgatgttttaatctgactttttatggttgaaaaataaaagtcttaatccgtttatggttgattagttacgaccgcctctcattgcgcggatcgtatttctggacctcgtccaagtgcttgatcatcttgttgaccaaccgctcgtatgtgtccaggtcctctgctgtgaagtctgcgaatatcttttcgctggccctccccatcacctcgtcgatgtccttcaacaccctgcggccttttgcagtcagtacgagggaccatgtcttggagctgctctcgttgacgacgtatccgtcggccatgagttcgttgacgaccatggatatacgcgatttatcgaacgggagtatgcgggccaggtccttctgggacatatggggggcggcccctatctcggctatgaaaggaacatggtatcttttgatccccgtcccgcggatctgctgcgacaatacgttacggaagcacttgccggccctttccgggaaatatattatgtgtttcgggacactgtattcacccacgcggaacatgctgggttcggataggatgaagtcatcgtcgctgtccgtttgatcatcatttatgcgggcggaccatcttctgatggtcgttatgctgcatccgaccgtttcggccgtctctttgacgctttttcccgagcgcaggagatccagtgccgcggagacgtcggcatcgctgtaacggagtccttccgaggctgtaccggtacggctgttgaaggtgtggccacactctttgcagatgaatttgcggactctctcctcacctacaaggtaggttccgttgccgactatgttcttccgacctttctgtccgcggagaggacaatcctccgcaggacatgctacgtcatcgaagttctgtctgcggcctctgatgtcggtcatcggatatcccgccctcgtcatcctgatattccagtatgtctcctggttggcaatccaaggccttgcatatcgcattcaaggtggagaaccttatggcggatatcttcccggtctttatcttggaaagattgacgttggttatccctactttctccgaaagttcgttgagggatatcttcctatccgccattatcctgtcaagtctgagaactatcgtcataggatcacaaggtctcgtccgattccttctgcagttgcgcaccgtatccgaatatgagtgccagtgaatacagtacgatcgcccctccgatctgtacgaaagggatgcttccggggtagttctccggattcaggaccatgatcccgacgacctgtcccactatggatgccactgcagatacgacggatatcgtggccatgtgcaccagtatgtgggcgttgtcgttcgtgaagggggattctccgttcttcatcgtcttgatcatgcggtccaggaggtaggatatggtggtgaacgctgcaaaatcgatcactgcggtacccatggtgattatcatcgtatgacggtcctggtccatgatagtcgggtcatcgatcacaaggaatatgcagaaagccacgatgctcaaggccagcaacagtgtgcagaatatggtcaccaatatcaggaatatgtgaccgtagccgcatatcttcctgagtttagatagttccgggctttccacgacatttcctccagaatttgatgatgtcgatgacatattaatgaattacgtttatattttattgattaacgataaaaaattaatgaaatagataaatcattaaatacagtgtccagtatgggagggatgctgaggcaatcaacagggggataaaatgaaaacaaacatgccggccggtggtcataacggggggttcgaatgagttcggactaccctatagaattcgtcgacctgaggaaggagtacggtcagttcatcgcagtggacggcctcaacctccagataaaaaggaacagtttcacaggacttttgggacccaacggtgccggaaagagcacttccctcaagatccttacgaatctgatccatgccacctcaggtcacgcatatctcaacggtgcagatgtcacgaccgataccaagaatgcgctaatgggcgtcggaaccgtggtggagactcccgaattctatctgtatctgactccgcgcgagaccttcaggtacatcggagagatctacgggatgtccaaggaatccatctccagcgagacgcatgcgatcctggagaaggttaagatgtccgagtgggccgacaagaggctcggaacgttctccaaaggtatgaggcagaggatcgccctcggtctttcccttatgaacgatccccgcatcataatcctggacgagccgacatccggtctcgaccccagagggatggcggagatgagggagatcctgaagaatatcaggaacgacaataacgacctcaccatcctcatgtcctcgcacatgatgcacgaggtcacagacctttgcgacagggtcgccatgatcaaccatgggaaactcctgctgcatgacgatatagagagggtcatcggaggttccgacgcacgcactctcgtcgtgaagacggtgggtgtacccgatgaatccgtgatatcggccatctccggtctcgggaatgtgaagtccgccttccgttccggtaacgaggtcatagtcaagttctcaggggagaaagaggaggaggccgaacttttcagacagctggcacagttgaatgtcggagtctacagcatctccgagagcgagaatgcactcgagaacaggtatctcgagctcatcaaggagtcgaggtgaggtccatggcatacggtacaaaaggtcccggaatgacgggttatgacgtcctggatgatttcaggcaggctttcatcgtcatgaagaacgagatcaccaagtatgcgcgcgggaagaagctgatcatcttcgcagccctcaccgcattgatcctggccgtagtcacggccgccctgaccatatggggggacggtctaggggacaacagcaacaatctgtcctacctgtacatcatgatcatgtccctgctggtcctggtggccataacattgttcgcatccacggcccttgtgtcggaattcgaggagcgtaccgcactcatcctgttcaccaaaccgatacggaagtggtccatattcctcggaaagttcctcgcttccctgatcgtcacggtcggattcgtcctgatctattatgcggtcgtcatcatcctgtgtcttatcggtcccggatatgtcgacggtgcgatattcgtgtcgctgggactgtcggtatgctacacgttcgggtgtgcggggatcggtttcctgatcagttccgtgatgaagaagtccagtacgtcgtctattctgacgttcttcacactggcactcctccttaacatggtcctttcggtcatcatgatcgcggcacacatcgaggatccgtggttcgtcctgacatatgcggccaacgatatcctttatgtcctggacccgatgcagaccgcacatgcggcaagggctgcagcggtgatgatcatatggggtgtcgccagcgcgctcgtctcatacttcctgttcaggaagagggatttctgaaacattttcgggaggggaccacccctccttttccttgtatcatccggtatggcgacggcccgcatcgcaccgaccgtcggttccgatttaaaagaccatatggttcacgcatgatgagccagcgtgtgaaaaatcgaattgttttccggcgggagtataatgatcctccgccggaataatgggtttgcgttcagacaactgggatctttccgtccagcgcaagggcgtaggccagatagatgttcaacaagaagttcgccagagaaacgattccgatgatccagtgccagtagtctcctcctatgacggtggaaagtccgacggtaaggaagatcaaggcggtcgtgagacagatgaatgtaagggtctcgggggtcttgatcaatgcggaccatatgagtgccatgaggaagactattccgaacgttatgcattcccactcgcccattccgagtccggtgagggtcaccgcggctccgacgagtccgaatacgatgaatccgaaattacttccgtttctgtatgctatgtacgatacgacaaggatcagtatacccatcagggtgaagaactcccttgtcggaaccccttcgtctttcagctgcatgatcgccagcggcagagagacgatggcgaccaggaacagcccgaaggcggtagggtcaatcttgtagtcagtttctgacatcttacttcttcctccaataaactgtttgtaaatggtttggaaacgagttggatgaattatctaatccatgagtatataaagtatatgtccaatgagaaaaaatagaccttactttataatcataatgtagttagactcgaaaatgttggggggattaagcgactaacagtacccgttggccgtttattttaaataatatttgtcttaattcccggcctcttcaactcgatgggatttaactgttggatggattatcggtcctttcggccacgtgtgccttgtatccggaaccccattccgcaagggagtccagtaccggacggaggctgctgcccaattccgtgagggcgtattccacccgcggaggtatctctgcgtaggccgtccttgtaaggatgccgtccgcttccagctcgcgcagcttttccgtcaggaccttctgcgatatccctccaaccgacctcctcagttccccgaacctcctggtcccatccataaggtcgcggaggatcagtaccttccatttatccccgatgagaagaagtgtggtctccacggggcatgcaggcagttctctcatatccaccacatggtttatctgatattaatcgggagggcgggaccccccgccctcctccctcactgagggaagaacatgccggcggtcatcctcagatagttctccccggagtatccgggatatctttccttgaccgcatcggagaattcctcggcggacgagcatcttgccgcgatgtccttgaggccttcgatataggagatcttcatctgtacgtcggacctgtcctccgggccgtagtgcgcggacaggaacaattcgaatccgtcgtccagatacttctgcaatccggctatgacggcatccgcatgcgcaggtcctgcaattatggagtggcagtcgtgtcccagcatgtgcatgtataccgccttctcatcgggtatggttatttcgaacgcatccccgttgggaattatcgtgagtccgatcccggcgatctcgaattctccaccctgcaggtcctctcccgaccctacggccgaagagtcgaattcgggaccgaatgccttagcgaagtttcctatgagtgcggctccgcctccggtcgagttgtacttcgcggcgctttcggtcagatagttcttcacatccggaaggaaggaacttcctgcggcatggtaggagacgagcttcccctctatcgtcacgttctcatcttccaggtaatgtgccagctcttcgatgttcctgcggaaggcagggagttccacgaccacgcctctgccgtccttgtccagtatgatgactctgtcatcgatggcgtccttggtgtcgtatacgcggatgttcatgtctccgcatgcgatcttcgtaacctctccgtattccaacttcttcttctcactgttcatttctcgttctcccggggaatcgtccccttcgagatactactatctctttcgaatataagtatcaaaaagaaactaacatgaaacacagttacctgcacgttaccgggtcattccacatcggatgcgcagtctgcatatacttaatctccgttaaccagtggaaggtgagtacatggctagactcgactacacatacatcgatgccgggaagtactgctatccggggacgtccgttccggtcaacaggtccggtgccaaggacatggactctctcaaaaccgtcgtatcggaggagttggctaaaaaacaggccgagctcgccgagatcggagggctgggaggaaattacaaactgggtcatttccaggcgttccacaggttcctcttcgagaacgtcttcgattgggcgggacaggtcaggacggtggacatatccgacccccgtttcgtcaaggcggacgggatcgcagacgaggcgcagatggttttcctgaggctggagaacgaggactacttccacggtctggaacaggaggacgtcgccgagcgcatctcctactacaccagggagatcgacaggctgcacccgttcggatatgggaccaaggagaccttgttcgtctacttcaagcagatactcggaaggctcagatacaaagtggactacgaggccgtatccgaggaggcatgggaggaggcccgcgccgccggaatggatgacgacctttccaagtatgaggagatctacaaggcgatcataaccaagatcccccgcgagaagaagaaatgacggtcggtcccggggctccgcctttgcggccggctccggaccgatatcatccattttatcaatccagatcattttagatgtatatttctgtacacgaataccgttgactagtcatacaccattatatcctgtaaggcattccgtcaagacagtgtaagtcaacattatcgggggataatcgtatggacgacgacatcaggatgcgtgtaaagatggaactccctttccttgtgagggtgctcgcaagcgatgctgtggagaaggcggtggaattcatgggaaagttcggtgtgaagcgccgcgaggtcagatacatcatggccttgtggggcggaccgatgacccagaaggagctttgcgagacccttcttctcgacaaggccaacaccgcgagggccatcgcagtacttatcgagaacggcctggtgcgcaaagacaaacgcggggtcggcagatcgtacaaggtcgccctcacacctaaagggatggaggtcgccgataccatgaaccggttcctcgaccagaacatagatgtgatgtgcgccgatttcccggacgacgtgatgtgcaacgtactgaacaccatggagaccatgtgcacgaatctcgatgcggacggaagcgtagcgaacaacatcgacttcatcaaaggcatgatgtcggatcgtctggaacaagggagcgggccggacagctgagggtgtacgatgaaggccataaggaatttcctggacaagatcgaccccgaactgatgatccaggaatccatgtatggcttcgtgatgtccctcactttcatcaccgccgcccagctgggtatattccattacagcgaccgtacggccctcatactggccataatcggcatggatttcgtgtggggttccatagacatgtacatcttctacaggatggacatgatgtccctccatcggcaggtcataaccctggggaagatgtacgtctcggaggacaggtcctccatgagggaggaggtcgacagggagctcgacgggaccatcttcgacctcatggacggatccacccgcgagaaggccgtggatctcgtcatgggcagcgagataggaaacttcggaggatacaggaaggagaagaacaagtatctcttcaacgcggtgtccgccgccataataacgttcatgacggccatacccgcggtggtctgtctcctgctcatcggggacgatacgacggcgttcttcagttcctcggcaatatcgagtctggcacttttcttcataggctacaggatgtccccctacaggaagaggtccatgaaggcgctcacaggtctgatgaccaccgcggccagtctgcttctcactcttttcgccgcatacttcggaggatgatgtgtcagtctccgtcccgatgtcggtttaagtattcggacgggattatacagggcatgtccgttcatatgccgacggtacccgagaagaaggataggagggtggccttggtcgtcgtagatgcccagaacaagttccttgtcggggcttcggagcaggcgatccgggggaaagaggcccatgtgccggtcatcgcagaggccgtaaggatgttccatgaggctggacgcccggtggtattcgtcctgtatgacggggtaacccattacatggacaggaacactgcggaaggggatgccatattcgaggggatcgatgcccgtcccgacgacatatacgtccacaaataccacatgaactccttcaggaatacgtgtctggaggacgtcgtcaaggaggcgggatgcgacagcgtccttctatgcggtatgtatacggatttctgcgtcatgtccacctattggtcggccattgaccacggactgacggccttcctgctcaaaggtgcactcatagccacggaagagagggtcaacgagatgtattcggagctctgcaagacgttcgacatggcagaggtggaggataatctccgtaatgtgaagacgaccccgtgttccaaggacccgatggacgaccgaggcggatactgccgatgtgccaggctttatctgcaggccgtcaaggacaaggagtccaagagggaggtcggactgatggagaaggcaggcgggatagatctcgtcgtcgtgaaccatttgccgaaggacgagatagccagaaccgagatcgacgaagacgggaggttcattgtcaaggtgcttccgcaggagctgaggaacaaggagaccctcatccatgagaccgtccacatcctccagtgcatcgatcccaagcgccctaagaaggagaaggagatcgtcaaagagtctactacaaacaaagacctggaggcgctgaacgaggcgttggtgggggcggaatccctctcccgcgttgataggctcaatatcgatcagaacggataccatgtgtatctgggacatatagggaaccgtacgatctgaaggaacaggaccacgaactcctaaggagcccggagaccgtcaggaaagggtcgtatcagaaagacaccttcgacaggttcgacgataccaacatcaaagagctctccctggacggcagtgcgaaggcgatcgacacgaaaaatagaataatgccgaaaaaggattccaaaggaggtgaaagaaaatgagcctccatatgaacacgatcgaagagatagagaggcacgaccgcgagagattcgagagactgggtctcaccaaggatgaggccagcatcttcacgatgatccacatagacccccgcgggaatctgatgctcagatggacgataggccacaacaagaccccggaggatttcgtgcggaccatcaactccggtctgcggaagatcgtagaggccggggaggatgaaatctttaccgactgcatagcggaactccacgaggacgccgtctacatgaaacgcataggcggaggccgtcccgcagtattcccgctggacgaggacgaatgggaggagggcgactacgaatactgtccggaggacgaactgttccacaggaggaaggacaggtccgggctttaaggcacgcatcgtccaattcttgtgccgtgctccgggccccctaccaccttttcgccccccccctcggtcaaccggagttggaaaaaatggaaaacgaaaaaaaattgcagccatcctcgcgttcgcgaagaagaacggctgcgtgaagaccagcagcttcaacgtccacctgagcaatctgggtatctacggcgacaaccgcggggggaccctggattgcctgacctatctcgggtacatcgagaggaccaagccctccggggtggtctacctgtggaagatcacgcctgccggcgaggattttctgaaaaggacggaggcgaaggcatgagggcggccgccgcggaatgtggcaactgttttgaatccccgatgtgtaaaggatacacatcaactgtaaagggaggtgagaaaggaatggcaagcgaatgggaggaactggagaagctctccaaggacgagctcatcatcgagctcatgagagagcgttgggcgcatcgtaacatcaatcagcgcctgcggatgattatcgactacgactatccggactccaacgagatcccgtgcgtggtcgaggaggacgactattcgtctcccggatacgagacgaccgacacatgggcgaagaagatcgttcttcatgcgaagtctcgttgcacaggagagttcggaccggaagatgcgttcgattacggcctaaactgggaccaggccgaacaggcgttcgaagagcttgtgaccgaaggaaaactggactggcccagttcggatccccgtagcggacgttttagcggcatagccgggttgtacgccgacgaggtggccgtcatggaccccgaggagcgcgagaaaagaatgcgcgcggagaggggcggttccgatggccaagcataaaacccccatcagggaacggggtcccgatatggaggccaacacggccaccatcgaggccgacactatcgactatcccaagaaattccgccggtcttggtccatcacgccgccaggaccgaagccaccggcaacgttattgtcaggatcaggaagcagtttcccaattcagacggtaattccaagaggcccgaagaggggagcgttttcgaaggtgacgaggtcgagatccaatcacgtaaggtcacggttaacaagtcggacgggaaaagtgccagagacagggcgaccgccagcatgggcgtatggtttttcggaaaattgaggaggaggctctgatgacgggaatcgctggcgattcccgggcccagcccatgtccgccttcacctgcggccactgcgtgacggtccttttcggttccggcgaggggacgcatcgatggtccgtccgttcgcatccatccgcgagatcgccgacatgatggggcacagctcgatagagcagatcctgcgctatatcggagtggatatggacgatatgacggatgcaatgaggagcttcattctgtgaatggctcccaaaacacgaaaggaatttgataatttggaaaaattaattggaaaagaacgagccagcatttgatgtggggctacccggatttgaaccggggtcaatggctcccaaagccacaagtataccaagctagcccatagccccttgtttctccgcttaatgcctgtttctatttagattatagcattagatacggcatcagcggaggatgcggccttcccctcagatgaatccgcggttacggagttcctccaccagcatgcgggtggccacccctctgtgggagatgacgttcttctcctccacaggtatttcggcgaaggaatgttctccgtcggggctgaagatggggtcgtatccgaatcccccgtcccctctggcactgtcgagtatgaccccgggacatttcccggtcacgatgaccgtctcgtcccctatcctgcatccgatgcagcatttgaagacggcggccctgtcgtccacgccctccatcagtttgagtatcccttcattccctatggtcttctggccgtaggcggaatatactccggggaatcccttgagggcgtcgacgaacaatcctgaatcgtcgatcatgaaatccctgagaccctcggcgtacatcgacttgagccccttatcgacgacctcctcgagatatgcggtctggacctcgtcgtattcgcggttgacgtgctccatctctatgccgtatcccccgagggcttcctggtactcccttacctttccggggttgtgggttatgaccttgagtttcatgtgtatcttcccctgtcctttatctcctgcaccttgtccatgacctggtccgggcaggtcttggtctcgcagtacgatcctatgagttccttataggcctctcctaacttggggtgggccgacgagaacgccctctccaacaggcgtatatccacgcccatgtcctcggtctccacgagggatgcccccatcgagaagtctatgatgcagatcctgccgtctccggcgatgatcatgttggatgtggtgaggtccccgtgggcgattccggcattgtgcatcatcgctatgttcctgccgatctcacggcatatccgggaggcgtcctccggatgttcgtccagatggtgtttcacggtctccccgcccacgtcctccatgacgagggtgccggtctcggtgtccgcataatatatgaccggagtgcggatccctgcgcgtctcgcctccctgacgagacgggcctccgagcggatcctctggttgcggatcttcctgtccagctcgggtatgcggtaccccttgggcgacctgaccttggctatcgcacttctcccgaggaacgtggtcctgtagacgctcccttcggcacctttcgcgatctcggtcatgccgtccgtatccatatgcgtcggccatgtgttattcgtaattcaaacattcgctccgacgggcccgtatgtctggacatactttaatcaacaagtgcaacataatacgagtgtgaaccgcatacccacaggctgcaaatcattggattccctcttaggcggagggatcgaggcaggcagcgtcacgcttttctacggcgaggcgggatgcggaaagacgaacatctgtctgcagatggcctacaacgtcatcagggacgggaagaaggtggccttcgtggatacggaggggctgtcctacgaccgcatacaccagatattcaaagacgacctcctcgtcaacaaccttctggttttccaggtacacagcttcctcgagcaggcggaccgtgtggaacagatatccaagatcgcaaggaacggtctgctgggtcttatcgtggtcgactccatgaccatgttctatcgtctgaattacgacaatcaggagatgaagaacagcttcatcaggcagaccgagacccttctcaacatagccagggagtatgaggtgcccgtcctcataacgtcgcaggtctacaccaatatcactactggctcgatagagttcctaggcggtcatgccatgcatcacaatgccaagacgatcataaggatcgaccttcgcggtaacggggtgaggacggccgtcataaagaaacaccgcagtctccccgagggcaggacggccatgttccgcataaccgccgacggtgtccgcgacatgtgaatccgggatgctggtacatccgttccgttgaaaaaattaaatggcccgggggattttctcgccgggccgggatgttttcagacttccctgttgatggcgtagtcggccagggagagcatgaactccttgtcctcgctctcgggcaggatgtccaggtagctcttggcggaggcgatcttgtcctcggcggccttcttgttgtagtcgatggcaccgatctccttcatgatctccatcccttccctgacctcgtcctccgtcgcatccatgttcccgaggacggacttgaacttggcgagtttcttctcgtccttcaggtgttcgagggtgtaggtgaccatgagagtgcacttacccttcctgaggtcgtttccgaccgattttccggtcttggacgagtctcccgctatgccgaggtagtcgtcgtacatctggaatccgagtcccatgtcgagggcgaacttgttgatggcctcgacggtcttggcgtccgcacctccgcagagggcgcctcctgcggcggcggccgcgaagagcacgctggtcttcaggaggatggtctcggtgtagacctcttcggacacgagctggtgctcgttgcagacgtccatctcctgtccccttgcaaggtcccagacggccttcgtgacgtatctgaggacctccctcatggcatctgcggggatgtcgaggtcggcgatgatctggaacgccttggcgaagagggcgtctccggccaggatggcggtgggctcgtcgtatgcgacgtggatggtcttcatcccgcgcctcatgtcgtccccgtccatgacgtcgtcgtgtatcagggtgaaattgtggatgtactctatggcgacggcgaggggcatggccttgctcttgtctccgccgaccgctccgcatgcggcgagtacgatggcgggacgcatcctcttccctccagcgtaggggtattgtctcgatgcctcgatgagcctcatgggctcctcgtcgggtatgtagctctttatgggtccgtccacttccgcggaagtcttcttcagatactgttttgcgtccatctcattccctccatccaatctctggtctctcctagaacgatatacctcgccttcgcaaggtccttgatgttggcggagccggtcagcatcatggcgaccttcagctcctccttgaataatgaaagtttcttcttgaccgcctcggcggactcggtggcctccctgagcaccgcatgtgcacatcctgcggccgcggcgcccatggctatggccgatgcgacatgggtcccgtcgaggatgcctcccgaagctatgagcgggagcttgctgcatttggcctcctgcagggacaccggtgcaggtatcccccaatcgaagaacgtgttccccatctcggtctgtacgtcgtctccgatggcggatgccctgtacatctcgaccgcggcgaagctagttcctcccatgccggccacgtcgataccgtggatcccgatgcctttcaaccgttccgcggtgtatgcgtcgatgccggcgccggtctccttgacgataagggggtactccctcgctaatccgcggatggcgtcccttatgcccttgccgttcctgtcgccttccggctggacgacctcctggaggaagttcaggtggatggcgacgtagtccgcatcgatcaggtccttggcctgaccgaccatctcgggcgagaacatgtctttgctcttctgccttaccagctgcggtgcaccgatgttgccgatgaccagcgggacgtcgtagtccttgatcacactgtagctgtcggggtctacgccggtgacccccgcacgctcgcttccgacccccattccgataccgagttcggaacacgccttcgcaatgttctcgttgatcttcttggccccggggaatcctccggttatggccgtgacgatgagggggaactcgagcttcttccccaggacgtccgcggtcatgtcgatgtcgtccatgtcgatctccggcatggcgttgtgcatgagccttatgtcgtcccagtagcagttgtcgggagcgatcctctccgtgaggcagatgtctatgtgttccgccttccttcctcttattccggtcattccattccccctttggctacggtacatgtaactgtttcgccttttaataatgagtacaggcggttgggtgcgttaccgttgacgaggtagcaacgcctgttacggtcggtcatgcggagcatagcctccatcttggagtggacgcctccggtgacgtcggccaccgttatgtccgtcaaggcctcgtcgagcttcttcctggtgacctccccgatgagcctcgccttcttatccgtcttcggatccgcggtgtagagtccgtctatgtcggatacgaagacgaccttttccggatcgaacatcctgcagaggacctccatgcactggtcgccggatacgatggcgaaacccttcttcctgtcaggtacgacatccccgaacatgacgggcatgataccgaggtccgcaagacgccttataggttcctcgttgtcgacgatgagcttcccgtcctccatcacgaaacacgatcccggggccacggataccgcggggatcccctgggcgaggagttcctcgacgaccatggacgacaattccctggtatcgcacatgatgcgggcggcggcgggtatctgtccgtcgtcgacgtgtccgtcctgtatggcgtactttttggcgatcacgtgcccgaaagaacccgcgccgtggacgaccattacatcctgtccggagcgacgtatctcgtcggccagcctggagaccgtctccttgttgaatttgtgatactcggacttgtcggttatgacgcttccgccgagcttgatcagtatcatcggggcgggctataccgtttataattaaaataataggtatggggcggtggccgtccagatagatccgagaatagcgtcgcccacagaatgaattgaaaaagtggtagacagcgtgtctgctttcccgtacacttgcgcaatacagtacgcgacagatacgcgagcgggcttaacttccgggttcgagatgggaccgggtgaaccccgctgctatggccgtctgaccaaacctatagatatcgtcattgtatataaaactatctgataaagggttagatcccggcccgaaggccggaaaagatgttcactgaggcttcttgatatcggcttcgccgctgtcgaggaagtcgttccagagtttgagggtctcctgggcctcatcctcgtccatgacctctattgcgaatccggcgtggacgacgacccattggccgacttcggcgtcgaccatggagacgttggcggtcttcttcgatccgccgaagtcgatgtacgcatcgtctccgtcgatcgccactatcttgccgggaatagctagacacatgcctatcactccgacattatcttgatgatggcctcggcaggttggccgtccgtttcttccagtgcggcgatggccttgtccctgtcgcagttggtctgggacatgacgagttcgatatcctcgttggggaacgaaggtcctgcggacacacctcctgccgatccgggtgccatctcggtctccgttccggagacctggtagctcttgcttcctttcacgtcgacacagacgacttctgcattggttatgacgatgtctttgtccttggtcctgattatgacctcggtcacaccctctatgttgttctgcttgattcccatcgaacgcattgcacgttgcatctgacgagggttcactcccctcattccgcctgccataatggtgcttcgatggcattcattgatattaacgattgggtcctttcaaaggaatgttaatatcgtcctcccgtgatgacgggttgtgatgtcagcaaagaacctgttcgcggacgaacctgcggtccatgacgcctttttcgcggtatggaacaagataaggtccatctataccgaggccgaattggaggtcttcgaggagacagtggtcataaaagacaacaacaggcccttctgctggatatgggcccccgccccggggaacgatacctatgaggactgtccaatagtcgtctcattcggtctcaattacaaggtccagccgcacaggctgtgcaggtgcgtacaggccgcacccgaccgctggatgtaccattgcggtatagagaaggatctgggtctttgcgatacggtactgagtctcatcgaccgggcccataaggacaaggtcgacgagacttcctgaccttcagagatttttccttatttctgcgatcagggaatcatagacgtccttcgccttggatgggtcggatatccctccctgtgcgaagtcgggttttccgccgccccttccgccgaacatccccaatacggcagggagggccttcttgcaatccaacttggatgtactggaggcgaggatcacggacaccgtgtccgataccgacacgaacgcggcgaccccgcccttggatttgaagccctccgccgcatcggtaagggtcttcctatccgcatcggcgaacatgccgcagtagacatccgttcctccgatgttctccgggaccatctccctgatctgctgtttggccgccgcctttctggcctccgcggcaagtgccagatcgcgtttcatattggccacggtcctgacgatgtcctccggtttgcttccggtctcgtcgatgatctgcagacatgtattggccagggccatggccgcatcctgtgcggcgctaccgaccttgaagtggatagcgataccgtccttccctgcggagaccttcctgtctacgaacagcatgccgagttcgccggtctccatgacatggatcccgctgcaggccgagaggtctatgtcgccgatcgacacgaccgtgatctcctcgtcctccgctatcctatccagttttatcctgacgttctcgagttccgggtcgtccctgctcatcacggtcttcctgaccggcaggttgtcgcggatcgccttgttggcgaattccagggctgctccgatcttttcccacggcacgtcgtggttcacgataacatacttttcttccggacctatgaagatcttcgtgatggtcagctccggatcctgtcttttcagggagcagaacaggaggtgttccccggtgtgtcccatcatcaggtcgaaacgcctgtcccagtcgacactgcaccaaacgcgcattcccggtttgaaatcgttgcctggcactttgtggattatctccttccccttgtaggagacgtcggtgacgggcatgccgttcatcgtcccggtgtcgcatacctgtcctccccctccggggtagaatgcggtgcagtccaatacgaccatgtcaccatccaccgaaactatgcccgcctcgaactccgacatgtatccgtcgtgtctgaatacctcgtcagccattgctatcgtccttgtgaacggtgtcccgatattatattttgagtgccgggtgatggggtctatgcgaatggacagatgcagccgcaaggccttccggtctgttcaaacgtctatcatatccagcgaaccattaaatgtcgccgacaggatatgggtcgttaaccacatccgtttaggatcggtcataggaaggatgcaaaatgggagacctgaaggatttcgacgaactggataagcgcataatagagatgatgtgcaactccagccaaggttcctacaggcagctcgccaaacagatgggtgtccaccctacgaccctcatacagcgcgtcaagaccctggaggcgaaaggggtcatcaagggttaccgtgccaaggtggactatgtcgccatgggatacgattacaacggtctcgtccaggtgtataccgacaacatagagagcgtggagaaggagctcgtcaacatccccgaggtcgcggcggtatacgatgtgaccggggaggccgacgtcgtggtctacctgtgctgtctcgacagggacgagttctccgcagcggtcaagaggatcaacaaccttcccggcgtcgtgaagaccaatacttccgtcatactgaacatcgtcaagcccgagagcgatttcatccccaagatggtggacggcggtcagtaagcccccatatataacgcgcgtgcgtccgcgtgccatttttaaatatgaattgagcatagccgagacccagttataacaattgaggcacctcaatgagaagaacgaacacttgcggagaactcaggtcctccgacatcggaaaaaaggtctgtctcgaaggatgggtaaggttctccagggaccacggaggggtcgctttcatcgaccttgccgacaggtacggcataacccaggtcgtattcgatccagaggatcttcccgcaggggcggacagcgaagggatccagaagaccatggccacattctcgcgcgaatcctgtgtgctcatagagggtaccgtgagggcgagggtcgagggcacggccgtggagaccaacccgaccggggagatagaagtactcatcacgcatgcggaactgctttccaaatccaagcttccgcctttcgagatcggggatcagaaggaaggagtccttccggacgaggacacccgtatgaaatacaggtatctcgacctccgcaggaccgatatgatccgcaccatggagttcaggagcaaactagtccacctggcccgtgtctacttggagtccaaagggttcctggagatcgagacccccatcctcgggaggtccacccccgagggtgccagggactatatcatcccctcccgtgtacatcccggtaccttctatgccctcccccagtccccccagcagttcaaacagatgctgatggtgggcggaatggaccgctactaccaggtggccagatgtttccgtgacgaggactcccgtaaggacaggcagcccgagttcacccagctggatatcgagatgtcattcgtcgacagcaaggatatccaggatatgatcgagggaatggtcgcctatatgtggaagggactctacggcaccgagctgaagacacccttcccgcacatcggataccgcgatgccatggagaggttcggatccgacaagcctgacatgaggtacggactcgagttcgttaagctcaccgacgtcgtcagggacgtcccgtacaagatcttccagagcatcctcgccgagaacggcatcgtggccggtatctgcataaagaaggagatgggagaggtcggaaggaacgaggtcgaccgttatatccagtatgcgaagaaagtggggctgggaggcctcacctggatgaggtgcgagaacggtgtcctcaccagcaacatcaccaaatacttcacccccgagatcctcgagaacataaagaagaccatgggtgcggaggagggcgacctcgtcttcctcatagccggaccgtggaaggccacgtacgagggcggagggttcctcaggaagaagatcgcagaggatctgggtctcgtccccgagaacgagttcatgttcttctggatggatcagaaccccatgttcgagatcgatcccgtatccggcaagcgcgatgcgttccatcacccgttcgtcctgcctaccggcgacctcgacgaccccgagtgcggcggagcctgcttcgacctgtgtcttaacgggaacgagctcgggtccggttccgagcgtatccacgatgcggagacccagatcgaggtgttccataagctcggtctctccgatgagaagatccaggccaggttcgattattttgtcgaggccctgtcctacggcgcccctccccacggaggtatcgccatcggtatcgacaggctggtcgccatcctcctcaacaaggatacgatcagagaggtcatcgccttcccgaagaacaagaaggcggtatcgttgctcgacggatccccgtcgcccgtggacgatgagaagctccaggagctgcagatcatctctcttgccggtgacgacctcgacatatcggatgccgaagagttcaaccccgacaacctttgaaacaaaagacccagaggtgtccgtcggacacctctgcggcaattccgcataccttcaggatcatttcttcttgctgtcttgaagggcttcggatatcctgtctttcagaatgtatgtgatatccgggtgcatcccgacctcgtccgcatacatcatgcggatggtcctgccgccgacgtccatgtctttctccttccggccgacgagcccgagtatacggggtatggtctcttcggtatgtcttcccggagatacgaacatgggtatgaccaggatgtcgcgtccagacttcaggaggttctcggtcgcattcttgatgtccggcatctgatgtctttcgtatgcgatggacacctcgtatcctctctccctcaggtattccgcatccctctcttcatattgtatgtcggaggaattcttcttgccgtggaatatgaggaggacggaggtattgcgcggagatgcgtcatgggagtcgcatatctgtacgaggatggtcctcatcttctgatgatcgccgaatgtgccagtcagtactacctgtgcacttttccctccgtatctcaccgtcccaaaggtcttttccgtacagagccccagttctgctctgatcttttctgccgcagaggatctgggtgataaaaggaaggggaccgccacgatcatttcgacgtcttcatccagcaatccgtggaccgcatcttcgatactggggccgtgatgcaggtatgcggtcctgacatcgtatccggtctgttcatgtatgcgtttggagtgcagggttgcgggatctccggcgttcggcatttccgttccgtatgctatcagcaggacggcggtcttcataagggtgcgaacgcgggtacccgttattaaatggattgatgccccgggtcttcatcccggggcaaggttttcagagtctcgattcgacgatccttctgaccgcgtcgactatgtcggacgaggagtacttgcctccggtactcttcatcacgaatcctatcgcgctgttcgcggccttcttgttacctttgccgtagtcgctgactatctgcgggttctcgtccaagtatgcggatatgatcttgtcgaggtcctccgctcctgcggccgccgcctctacatcctctccggtcatgacactcttgagttctattccgcactcggtgtcggtgatggtcccgtcggagaacttccctatgacggcgaggacttcttcgatgtcgccgttcctctcgtcgaatctcttccagttggcggtgaccgggccgcagacccatttgaccgcattaggcgtaccgtatgcctccgcgaccctctcgaagaactgtgccagatccacggatgtggagaccagctgcttcgccttctttccgtcgatcccgtattgggccgacagtctctgggtcatcttggcgggggattccttgatcgtgatggatctggcaagctccccgatatggaatattccgaggtctggctcgtcgatgtatccgtagtccgcctcgaactccttcttcctggcaccataggtgatgcctctggtctcgtcgaaggcacgggtctccctctcgatcttcccgcctgccttcaggaccttgatctgcctaatcatctcatagcgcagggcggtctcggcgttcttcagaccggtgacgttcttgacctcgcacctctccttgccgacggagatgttgcagtcgcagcggatgctcctctccccgttctcggggaggtcgatggtgtgcttgatgtccgctatcagctgtgccaggaactcccttgcctcttcgggtgtggcgaggtccggctcggtgacgatctccgccaggggtatgcccgaacggttgtagtcgacgagtgacgacatgtccgacgtcctcttcgtctttcccgggtcctcctcgagatggatcctggtgatccttatgggtttcttgccgttcagatatacgacccctccctctccgatggggtggtcgtattgggttatctgtacgcttttgctcatgtcgggatagaagtatgtcttcctggagaaccaggtggtgtcggttatcttgcatccgagcatcttggccagcattatcccgtacacgaggacctgcttgttgaggacgggtctggatcccggcattcccagacacacggggcacacgtgggtgttgggtgcgggcgcatccgtggtggggcaggagcagaacatcttggacttcgtggggagctgtacatgtatctccaatccgatcttcatgccttcacctccgcatgtcttacatcgaactgcttatcccattcctccgccatggtaaggagctggtcctcgttccagtggtccgtcacgaactgcatacctatcggcatgccgtttccgtcgtatccgcagggacagttgagatgaggggtccctgccaggttgggcgggacggtcaggaagtcggccttatagttctccaccggactcatggccgagatgtcctcgaatctgggggatacgaaaggcatggtgggggtgaggaccgcatcatggtccttgaactgggtcttgtaggcgtcgatgacgcccaacctcacctggagggccttggcgtaatacctgtcgcggaacccttccatcctggtatatgtcccgagcagtatcctcctcttcgcctcgtccccgaagtactccgtcctgaagctggtgaagtattcgtcgaatcccagggtgaggtccccgtcctgatgcccgtacctcatcccgcagtacctggccagattggtggacgcttcggaggtggcgagtatgtagtacgcgggcatggcatatttcagatagggcatgtccacgtattccacgtcgattcccatgcccttcaatctctcgagggcgtcttcgaacgccctcaggacgtcatcggatatcccctcgacggcttccttgggtacggccacggaggtcatcttcctatgttccagtttcagatccggctgtgcgcacgaggtcgggtccttggggtccctgccggatatgacgggcaggtattcggacagtttgtgcgggtccatggccaacagtccgatcttatccagggagttcccgtaatcgataaggccgtatctggagacccttccgtatgtcggcactatcccataggtgccgcagaaactggccgggcagcatacggatcctccggtggagactccgagggatacatggtcctcgaggacggcggccgcacacgccgatcccccggaagaccctccgcaggacctgtcgaggtcgaacgggttcttggggacttcgaaagcggaattcgccgagaaggtaccgaaaccgaactcgtccatattggtcttcccgacgagttttcctccggccgccttcatcttggctatggcggtggcgtcgaatacgggacggtatccttcgaggatctttgaacctgcgcacgtctcgaatcctatcgatgtcaggttgtccttcgcggagaacaggaacttcgtatcgtcggtccattccccgccgaagtcgtggaacatgccgtagacggagttgatctccttgagtctggagagggtgtccttgtcgctcataccagcttcggcccccttatgtaaccttcataggtcttcatgtccttcagaagctccgcggggtctatgtcctgtcccgggacgtcttccctgagaacgtccgagacctctatcgggttgacgccgataccttcgtggtccggcgcctcgtcgaggaccttgaaataatccaggatatctgcgaggtttttgctgtacctctccagttcatcatctgtaagttttatgtgcgctgtcctggcgacacgtgcgacgacatctctgtccatgttgaagacctgcgcacccatcggtcgcacatattatattatttactgaaaagggagtgggacagggggaatcctcccccatgtcacataatgatgccggtatggtcttcaagctactgctatctcgtccttctcgttgtagaagacgaggccgtagaatgtggcgtatccgtcctcgaagcggaattcgatgccgttgtcctccagatactccatgagcatgatcccgtatgcgcttatggatccgaccctctggtccgggaacttgcactccttgggatatgcgcaggcgccgcagtagttgcatcctccgtcggccaggcacatcgacgggtagccgttctccttgaggaggttcctgaagtccctgaggaggttctgcagtatcccggacagtctcttgaggccgtcctggtccttcatgttgacctcgctcctgtggtatatgacgacggcatgtttgtacatcctgatctgcgtcatgcagtcccccaggtttccgacgcccggcgggcaggcccagttggtgccgtagcatttgcagacgttctgttcgcatagtttcctgcacttgctggcttcagaaggcgtcagtttggggacggatatctctttgaagacatagtctgaagcgtttttggcacgcacaatctgattccacaggtcttcaatcggcatagacacttgattgtatcttaacaatatattgatgttggatgccgtgccatgctggaccctccgcagggatgccatgcggtcccgttcggcggtctttcctaaaaaggttttaaaatcccatgctaatggggatggcatggcagacgagatatccggttccgcaccggagagagatcccgcggcacagaagaaattcgatgcggcgatgagagctatggacggaggagacttcaagaaggccttctctgcgttcaagaaatataccgacgaattccccaacgatgccgagggatggtactgcagggcagaatgcggcaactacgcctccgggatgttcggagccaaggtcaaggacgaggagatcatggacgcctacaacaaggccatcgagctcgacggcgacagggcggactactatcagtcctacggactcttctgcatctccataagcaaatacgacgaggcggagaaggcatacaacgaggcggcgcagatcgacgagagtctttccgcatccctttactcggagttcgctatagagtactacaacaacatcatggggaaccacggggatatcctggaggatcccaaggccagggcaccttatgccaagaaggccctcgagtacatgctcaaggccctcgatatgtctccggaagaggccaagagccttctctgacataccaaacatttccggggaccgtcggcattttgtgtcggtccccttcccatcttctgttccaacggatcccttcaaggacgtcgtttctcatccaatgtattgattttacataagattttacacatatttgtgcagttacagtaaaagtaaacttttgtttagacagctatattgatatatgattagacattcgtctaattaaaatccgaaaaaggatacattggaggtaaatttatgagaaagtcgttcaagatgatggccgccgctgtaatggttttggctacagcgatggtggctatggtcttaacatcacagaactccgccgcggataccggatcggcggattcggggagcatctcctggataatggtcagttccgccctggtattcgccatggtccctgggctcgccttcttctatggggggatgttgagaagacagagcatgtcgtcgatgatcgcgcagacgctcgccgcgatatccatcatgagcatctcctggatcgccgtcggatattccctggcattcggaagcgacggggtgataatcggcaatctgcagcatctgttcttcggaggactcaccgaagaggcatccggaggggcgatatccacattggaattcgccacgttccaaatgatgttcgccatagtgaccgccgctctggtcctgggggcatgtgccgagcgtatacgtttcaacgccattgtctggttcctgatcatgtggtcggtactcgtctatgcgcccatggcccactgggtctggggagggggatggttcgaccagttcctgaccgtcctcgacttcgccggaggtacggtcgtccacatctgtgcaggagtcacgggtctggcactttgcatattcgtcggtcccaggctgtccggtacacgtaaggcccgcgcccacagcatcccgttcgcattcctgggggccatgctcctctggatcggatggttcggtttcaacggagggtccagtgcattggccgacggtacggccgtccatgcgttcttcaccacccaggccgcaggggcctgcggaatggccgcatgggccatcgtacaatacataaaggtagggagagtcggagtgctgggtcttatcgcaggagggatctccggactggtcgccataaccccgggggcggcatatgtcggcttcgtcgaatcgatggtcatcggtgccgtcggaggggccctatgcttcatggcggtcaggatcatccggtccaagaccaagttcgacgacgccctggacgtgttcggtgtccacggtgtcggaggtatatggggagcgatctccacaggcatattcgccaagtcctcccttgcaggcgtagacggactcatctatggcggggtggacctgttcgtcggacagatagtggccgtcctggccaccatagtattctgcttcgccatgtcatatgccatcatctggctcatatcgaagttcatgaaggtccgcatacccgaggacgaggagtccataggccaggatatagtggagcacggggagccggcgtatctttgaggtgatgaatatgaagatggtggttgctatagtccgtccagagaagtacggcgaggtaaaggatgccttgaaggacaggggtgtgacggggatgacgttcactcccgtcaccggccgcggaatgcaggctggagtgaagttcaccaacagggtcggggagttcatgatcgacgagatcgagaaggtgaagatcgagatcgtcgtcgaggatgattccaaggtcccatgcgtaatcgataccatatgccaggcggccaagaccggccgtcacggcgacggcaggatattcgtactgccggtagagagtgcggtaaggatcagcgagtgggaaccggaaccgatgaaggaggcgcagaatacagaaggaaattgatccgacaaagcccgtccggactacacttcttcctcccggacgggcccacataagtggtgcaccggtcgcccaaaatccggtattttaatatctggcacatttcgtcggcatacgtccgtccgaaagacgatcatgatccgaatcgttgatggatgcctaaggaatttgaaatagatggaaaatctaatggtagcgaggggtcgatttgaacgaccggtctccgggttatgagcccgacgggatatcctggctaccctacctcgctatactttgccctacacactaaatgatatttaaagtaatagggtgaaaagcggccggtggagatccagccgcttttgacaatctgacgatcagaagaacttcttcaggaacatgaggtcctggatcttccctttgatggttattttcttggtgatgtatgccctcatcggcctgaggtccccggacaggagctgttcgaagtattcgggcgtagtggtgacgacgacatccgcatcctctgcgaactcgggtttgaagtctccgatcttggcgttctcgagcttcatggagtacttctcggtgtcgagatcgaagttgaagactttcttgagggattccacctctttcctcatctcttcgttctcggccatcttgttgttgcacttgtcgatgagctcctggatcttggcttccatggtcatgttgtttcaccagtcgtcgaggctcgtggtcttccgggcggaaagcatcttcctgacaggctcccacgatgtccgcgtatgctttggtgcacacccattatccttaatccacttttctatgaatcctgccgtgaccgcatcggacggatatcccgacccgatctccacgtcgaattccttacggaggtcgtcgagcatgcggtccctggtgaccttcgccattatggatgccgccgagaccaccgggtacagggcgtccgccttgtgggcggccactaccttgcggccgtcgagcctcgactccattatgcggccgaagcgttcggtattcacatccggacagtccgcatagaccgtgtccgccccatatgccgagaccgcctccacgaagaggtccagttcgatcatgttgagggactgggtcttcatcttggagtcgatatcctccgcggatatcggaacgacgcaccaatgcatgacggagtccgatatctcgtcgtacatacgttcgcgctgccccggcgagagtttcttagaatccttgacaccgatcctcttcaatacggaatcgtcatcgcagtagaccgcccctacgacaagcggtccgaacatcggccctctgccggcctcgtcaacgccgcaagagatcatgaggcgattatcggaggtcttggattttgttgtttcggacctataccatattgctggttatcatctaccttttaagtagtccgttcattacacgtagagcatggcattgaagtgtgacgtacaatacagcagaggctccaccggcttcaagctcaccaaggtcggtgtctccggggtacgtaagccggtcctcatcgcgaggcccggtatcaacaaccctctgagcaacgtcgtgaactgctccatagacattttcgtggacctccccgcagcacagaggggatcccacctttccaggaacgtagaggtcctcagggccgtcgccgacgaaagtaccgagaagccggtgtccggcctcgagaacatggccgtagacatggttaggaagcttctcgtgaaacacgagtacgctcagaacgcatacgtcaccgtcaccgctgaatacttcagacctaggaagacccctaccggaagggacaccctcgagatgtatacgctccatgcaggtgcccacgggacccgtgacggggccataaggaagaccataggtgtggatgctgtcggaatgaccgcctgcccctgtgcccaggagaccgtaggggagcttctgggagtggagaaccccggtttcccgatgatgtcgcacaaccagaggaatgtgtgcaccatactcctcaccaccggggaggatcagaacatagaggcggacgacctcatagatctggcagagagatccgtatcaacccccaccttcgaacttctcaagagggaggacgagggcaaggtggtcataaacgcacacagcaacaccagattcgtcgaggatgtcgtcaggaacggtctgaccctcatcgtcaacaattatcacgacctgccggacgatgtggaggtaaaggtcgtcagcgattcccaggagtccatccacaagcacaacgcatatgcggagaggaccgccaccatgggtgagctgagagaagagctggcgcagaatgtgccagcactttgaaacattttaaggcggcggccgagggggggggacctcccctcagtcgtcgtccgatctttcgagtttcttttcgaggatcctgatatcctccaggatgatgccgggagggcattccatcccgtccagatgtccggtccaatagactacgatcccctgaccgaagagttccgtgtaggggatcaactgtttcttggagttgaacttgaactccacggcatcgccgaacgacgccttgctctctatccagtggatctccttcccttcgaacatcatcggttcgtcgaggagacagtcgggggtcttcccctgatgtgcttcgtcctcgcgttcgtcggcctcggtctggtaggatatcccttggtcgtcgagccatttccagaggagaccctcgccccattgtcctctctccttgttcctttcgttggcgtcgggcgagtatgctatgtccttctccgtcgcctcgcgaagttcggcggcggtctccggactgtccagaaggtccgggtcgcggacatactcccagaatacctttcttccgcatccgtcctgttggaatatcatcatggcgacgagaatcggcgggaagttgtagcggtcggcgatctggcagatcgtctctcccttcttccaggccttgagcatctgcggggctttggatttcacggcatggaaccttttcttgaccatcctgttcactttctgggtgtacagggtctccagaaggcgtctgtcgtatccttcgtctatgaaacgctggatgtcgtcgatcccgttgagcccgtcgtagagcctcttatactcgccgtattccatcgggcatcactgcttgaggttcttggcaaggtcctcgacggcggagatcaccacgtccctgacctgggaggtcggggggcagtatgcgttctcagcatcgacgaggaactgttccgcggtggcgccggaggctatggccgcggtcatccagtctatgcgtccggtggcgtcctcccctgcgatgatctgagcgcctattatcctgtgggtattcttgtctccgatgacctttaccgtcatctccttggccccaggataatatctggcacgtgtgagtccggcagccttgccggtcacggtggatactccgtaccaggatgcaagtccgagggacatgccggtcccggcgatctgtttgtcgcctatcacggagacccagggggacatgaccgggccgaactggctcttctgtcctgccgcattcgctcctgcgaccctgccctccttgaccgcagatgaacccagctggctcatggtaggtccgctgtatactgcagactggcactgtatgacgtctccgcaggcgaagatgtcggggcagagcctccccttcctgtagcactggagggtgggtgcgaccgccagggctccgagctgtcctatgtccaggcccaactctttggctatgtccgtgttggcgcgcaccccggtcgcgaagatgaccatgtcgcaaggataggacttgcccagggactccacgctctcgacctttccgtttcctttcacggcctgtacgggggccttcatgacgaatttgacgcctttggattccaagtatgcctgcatggggtcggccatgtccttgtcggcgatcctgggtatgacctggtccatcatctcgatgaccgtcacatcctttcctatgttgacgagggacagggcgagttcgagacctatgacgcccgctccggcgattacgaccttgtcggatttcttcagatagctctcgatggcctttccgtcgttgacggtcctgaccacgaacactccggggaggtcggtcccctctatcggggggatgaacacctttcctccggtggccaggatgagggagtcgtactcgtaggtcttacctcctgcgacgatgttcttggtcacggtaccgtccttcgccctgtcgttgacggcgtgttccactttggtctgcgttaggatcttgatgttcctttccttcgcataccattcgggtgtgtgcatgatcatgccgtcccagtcggacttgccctcgaggacccagggaatcatgcagggggagtatgctacgtcggtatcctctgtgaaaactgtgatctctgcctcgggatctgcatttctagcgctagatgcggcagacatgcctgccgcacccgatccgatgacgatgatttttcttgccatgtggcttaccttgatttaagcatcatatgggcatgtttaattaatcttgccccgcgcacgcgcgaggctgaaccaaccattatttagagggacgctgtggggtgtccgatgaacagagagagacttccctacgagctcgaggcctcgtggaaagagaaggatatggcaggcggagagaccgtcgatgcccaggtcctgatcatgcgcaccaacgggtgttgctgggccaaggccgggaacggcggatgtaccatgtgcggttacaggtcggcgtccctgacgggcgtgacggaggaggacctcaacaaacagatagatctggcactttccaaatacaagggggagccgttcgtgaagatctacacctcggggagtttcttcgacaccaacgagataccggagagcatcagggaaaggatattcagcgaatattccggatgcaagaggatactcgtggaaagcagacccgagttccttaccagcaacctggtgagtactctacctggcacattgaccgtggcgctagggatggagtcctccgacgaagaggtcctccgcacatgcattaacaaggggttcaccgccgcccaaagcaaggccgcaggcgagctcctcaaggacggcggcataggggtgaggacctatcttcttctgaagccgccgtatctgacggaatcccgggccatagacggtgccgtggagtccgcccgttttgcggacccgttctccgacgagatatcgatcaaccccttgaacgtccagcatgccaccgtggtcgagaggctgtggaagagaggggagttcagatcgccgtggatatggtcgctgatagaggttatgaaacgtctatctggcacagtgaattccaggataatgtcctccccttccgggggaggttcccagagaggggtccacaactgcgggaagtgcgatcacgacgcacttgcggcgatagagaggttctcgttcacgcaggacccgaaggacctggaggtccaatgcgaatgtaaatctacctgggagcgttacatgcagtcggaaaggctcctggggacggcggacgaccttggacgcgcgttcggcagcgacctgatgattaggtgagacaatggcagatgcaatgacgcacttcgacatcaagaaaggatggttcagcaagatcgacggcggaaacctcaagaccttaatggaggaggtcttcggttccgtgaaggaggaaggggaactgctcgtatcctcctacggtgcgatggcgaggatcgaggccaagatcgtgtcaaagaccgtcctcgacgtggccactaccaacgtggatgataccaaggccctcagcgacgaggagatcctcaactcgaagaggaagctcaacgagttcctcgagaaggccaccggtttcgatgccaaggcccgtatgaagagggcccagcagaaggccaagaagggcgaactctgagccctccgaaaaccctctcggaaaaccccttctgcgcctaatatattataataaaaaatataggcgcagctttttatataaggtgggtatacacacccctagattggacatactctatgtctgaccagacgcatcgggcaatgcagacgcaccccacgttcaactcatgtcgagaacgacgttttcgagatggatacggcgtcacggtcagttcatgaaggcgttcgtctgaataagcgcgaggttagcgaagagaccctcgcaggtatgtgtaaaatatgccgcaaacaagacgcccaacaaagggttccagggcatacggccctaggaagagagcaaagtcgcagacgcccaggctagactcctggcccgagatcagcggagcccctaagatccagggattcgccggatacaaggcaggaatgacccacgcgttcgtagtcgacaagagagcaaagagcaccacctccggaatggaagtacaggtgcctgtgacagtcatcgaggtcccgcccatgaagatcgcggccgtcaggttctacgagaacaccattctcggactcaagaccgccggcgaggtatgggcggcagacgcagatgtggaccccctcctcaagagaagggtcaacgtcccgaagaggggagagcccgacttcggaaagttcgacaacatggatgtcgaggacgtccgtgtcctcgcatacacccagcccaagctggtctccggagttcccaagaaggtccccgacctcatggagctcaggatcggcggtggaaacgtgaaagagaggatcgagtacgccaagggcatcctcggcaaagaggtcaccatcaccgacttcgcacccgagggagcactcgtcgacgtcatcgccatcaccaccggaaagggattccagggagtcaccaagaggtggggtgtcaagctgctttcccacaagaacagcaagcaccgccgtggaatcgccaacctcggacctaagaggcccggatacgtgaggagcaccgtcccccaggccggtcagatgggataccaccagaggaccgagctcaacaagaagatcatgaaggtcggagccgacggaaaggaagtcaaccccaagggaggattcctcaactacggagagatcaggaacacctacgtgctcgtacacggatccgttcccggacctaccaagaggctcatcagattcagggacgcagcccgcattcccgccaaggcagacaccagcgcagccgagatcacctatgtctcgacccagtctcagcagggagcgtgatttgaatggccacaaccaacgtttattccgtgaagggagaggtcgcagggaccatcgacgtgcccgcagcattcgcaaccgagtacaggcccgacctcatcaagaaagcgatccttgccgcagcagctaactcgaggcagccttacggacccaacaagatgtccggaatgaggcactctgtcagcacctggggaaagggacgcggagtcgcacgtgttcagaggctcgcagacggaaggagggcaacccagtcgcctaacaacatctccggacgcagggcacaccccccgaaggtcgagaagatctgggcacagaaagtcaacaagaaagagctcaagctcgcacgcctgtcggcactcgcagcaaccgcatgcgcagagaccgtgaaggctcgcggacacaagttcgatgacaaggtaacattccccatcgtggtcgatgacgctctcaacgacgtcaagaccgcctccgaggtcatggcaatgttcgacgcgatcggaatcggatacgatgtagaccgcgcaaaggacggaaccaagatccgcgccggaaggggaaagatgaggaacaggaagtacaggacccctgtatctgttcttattgtaatatctgataaagacaggaaggccgccgtcttcaacggagcacacaacctgcccggagtcgaagtcgaggagatcagcaccctgaacacctccctgctcgcacccggaggagacgcaggaaggctcactgtctacaccaagtctgctatcgagaagatcggagagtggacagaatgaagcagagcgacatactcatcaagccgtatgtgaccgagaagtccctcaacctcatggccgggactcccaagcagaagttcaaggacggcaacaagatcgagttccttgttcacagggacgcagacaagcaggacatcaagaccgccttcgaagagtacttcgaggtcaaggtcgagaaagtctggaccagaatccagaaggacggcaagcacgccatcatccagctcgcagagggatactctgcagaggacgtcggcatgagggtcggagtgttctgaggtgaaaaaatgggaaaaagattgataccgcagagaaggggccgcggaggctcccactaccgctccccgtcccacagacatgtggacgacgtcaggatcccccactatgtggaggcccagggaacgattaaggacctcatccaggctcccggaaggaccagccctctcgcagtcatcgacttcaacggcaagaagagctaccagctcgccgtcgaggggaccagggtcggacagaagatcgaaatcggcggaaagaacatcgaggtcggaaacattctggcactcggttccattcccgagggaaccctcgtccacaacatcgagggacagcccggagacggaggaaagttcgtcaagaccgccggaacatccgcactcgtcgtcaacaggggtaaatccgtcgtcctcagcatgccttccggtgtgctgaaggagttcgaccccaactgccgcgcagtcatcggagtcgtcgccggaggaggacgcatcgacaaacctctcggaaaggcaggaaagaactaccttaccctcaggtccagatccgtcgccaacaagaagaccagcggagttgcaatgaacgctgtagaccacccgaacggtggaggaagccacccgcatgtcggaggaccgaactgccacggcaggaccgcacctcctggacagaaggccggattcattgcgcccaagaagaaagttaagaggaagtgatctcgatggcaaagaaaattatgggatccgcaaaggcctctaggagaaaatccaggaagaaggcatccgcgatccaggcgaggagaaagaaggagttcatgttccgtggatacaacatggaacagctcctggctatgcccttcgaagacgtactcgagctcctgccgtccagggcgaggaggacatacctccgcggcctgaactacgagcagcagctcgtcttcgacaaactcaagggagaggtagacggacctgtcaggacccaccgcagggacctgcccatcatcccccagttcgtcggaaagactgtcagcatctacaacggacacgagttcgttgacgtcgagatcaagcccgagatgatcggatgcatgctcggcgagttcgcgatcaacaggaaggcgccgcagcactccggacccggagtcggtgcgaccaggtcttccaagttcatgccgctgaagtgaggtgttaagagatggctactaacaaaggttacacgaccgtatccgaccccgacacctccgcaaaggctctgagcaaggagcagcccgtgtcccccaagttcgcccgcgaggtcgcgggactgatcaggggcatgaaggtctccgatgcccagaagaccctcgagggcgtcatcgcgaaagaagtgcccgtccccctgaagagatacaacaagcgtgtctcccacaagcagggtgtcggacctggaagatatcccgtaaaggcgtccaaggccatcctcgctgccctcaacagcgccgcctccaacgccgactacaagggactggactccgcaaacatggcgatctccaccatcaccatctcccgcggcatggtcatccccggccacaggccgagggcccagggtcgcgccacccagtggaaccaggagaccgtgaacatcgagatcatcatctcggaggttgagtgaaatggcatcagagaggaaattcgttgccgagaacgtccgcagggtcctgctcaaggagtacctcatgaaagaggtctcccgtgcaggattcggtggtctcgaggttcagaggacccccatggggacccgcatcatcctggccaccgagaggcccggactcgtcatcggccgccgcggtcagaccatcaagaacctgaccaccgtaatcgaggagcgcttcggattcgagaacccccagattgaggtcaacgaggtcggagacgtctccctcaacgcacagatcatggcagagaagctggccttctccctcgagaggggatggcacttccgccgtgcaggacacgccaccctgagaagggtcatggatgccggagcacgcggatgctacatcatcgtcgccggtaagctgagcggacagaggcacaggaccgagaaattcaaagagggttccataaagtactgcggtgagcccaagctcgacttcgtcgaccacggattcgcggtcgccaagctcaagatgggagtcatcggagtcaccgtcgagatcatgcagaacactgccaaactgcctgcagagatcaacatcctggaaaaggatgcggccgctgagaagctgcccgatctcttcggtgtagaggcagtctcccaggcagcccccgcccccgcagaggaggcagacgctgctcccgcacaggaggctgagtgatcatggcagcactgaagattgccgacatcaggaacatgtccgccgaggagcgcaacgagaagctcaaggagcttcgcaacgagctcatgcacgagaggggagtttccgccatgggcggagccccctccagccccggtatcatccgttccatcaggaccagcatcgcccgcattctgaccgtccagaaggaggaggagaagctctgatgtctgagatctgccctatatgcggactgccgaaggagctgtgcatgtgcgaggagatcgcacgcgaacagcagagcgtaaggatctcgatcgacagccgcagatacggaaaaaccgttaccgtcatcgacggtatcgacggaaatgacatcgacatcgccgaccttgccaagaccctcaaaagcaggtgcgcggccggcggaacctgcaaggacggacgcatcgaactccagggcgaccacaagaagaaggtcaaagccgtactggaggagatgggattccgcaccgaagtaaggtaagcagatgaacacaaccgaattcatgagatctgaactcataggcctcgacgtgagtgtgctgtcagcgccgttctccggcatatccggaagagtggtcgacgagacgaagaacacgttcaccattgaatcggccggaactgagagaatggtccccaagtcggggaacgagttcaggttcacgtatcagaacgagcagatagacatcgaaggaagcaaactccttcaccgacccgaagacagaatgaagaaggttaggtgaaaaaaatgacagcagatgtaaggaacattggaatcgaggttgccgctccccagggcgagtgcagcgacccctactgccccttccacggaaacctttccgtgaggggacaggtgatcgagggagtcgttgacagcgtcaagatgaacaagacggtcatcgtgaagcgcgactacctcaaatatcagcagaaatacgagagatacgagaagaggtccgcaaggtacgccgttcacgcggcaccctgcctcggactgaaggtcggagacgccgtgaagatcatggagtgccgccccatctccaagaccgtgtctttcgcagtgatcgagaagaaggtgtgatcgatgaagggaatcgcaggtcatcagatcaggggactccagcaggagtcggagatcaacgtcatcgacaacaccggagcgaaggtcatctccatcatcaccgtgcccgactaccacggtgtctccaggaggatcccgaaggccggagtcggtgacttcgtcatcgcatccgtcaagaagggaacccccgccatgaggagacagatcgtttatgcggtcatcgtccgccagaggcgcccctacaggcgtcccgacgggaccatggtgtctttcgaggacaacgcagcagtgcttgtcaccgaaaccggtgagaccaaaggaaccgacataaagggcccggttgcaagggaagccgccgacaggtggcccaggatcgcagccactgccaacacgatcgtctgaggtgaatgagtatggttagcagcaaagcaagagtacagaggaaggcacaggccaacgcccctgcacacaccaagagaaagatgctttccgcacacctcagcaaggatcttgccgagaaatacggaaaacgcaccgcaagggtctgcaagggagacaccgtagcagtccttcgcggagacgaggacgtccgtggaatcgagggaaaggtgctcgaggtcttcaccaagaccgggcgcgtttccatcgagggaatcaccatcaaacaggcagacggtaccgccgtcgcccgccccatccacgcatccaacctcgtgatcaccaagctgaaccttgaggaccccctcaggggagaggctcttaagaagaaggaggctgcagaatgagcgaccacatgaagagactggcaatgcccaggacctgggcaatccccaggaaggtccacgtatgggctgccaaacagactcccggagcacactccgtggaggactccatgcccgcaggaatggtcctgagggacatgctgaaagtatgtgacaccgccagagaagcaaagaagatcatcgccaaccgcgacatgatcgtcaacggaaggaaagtaaaggacgccaaggctccggtcggaatcatggattccatcgcgatccccaagatgaacctttactaccgcatgctcctgaccgggaagggaaagctgaccgtcgtcgcgatccccgaagaggaggccaaatgggtcctctgcagggtcgagaacaagaccaaggtcgccggaggcaagctccagctcaacctgagcggcggaaggaacatcatcctcgacgccaaccagtacaagaccggagactccgtcaaactggacctcgagaagaacgagatcgtcggatcctaccccctcgccgagaacgccaccgtgctcgtcatcaacggacgccacgcaggcaaggtcgaggacgtcgagtccatctctgcaggcagcgcatccgcacccagcatcatcaccttcaagaacaagtccgagaccgtgaaggagaacgtcttcgtcatcggtaccggaaagtccgagatcaccctgccggaggcatccgaatgaactccgacaaccctatgaggcagctccgcatcgagaagatcaccgtcaacatcggtgtcggcgaggcaggagagaagctcgtcaaggcacagaaggtcctcgacatggtcaccggacacaagtccgtgcagaccctttccaagaccgtcaacagggacctcgggatccgtgagggaatgcctctcggatgcaaggtcaccctcaggggcgaggatgcagagaagttccttgcacgtgcactcaacatcagggagaaccgcgtgtactcctactcgttcgacaaggaagggaacatgtccttcggtatctccgactacaccgatttcgatggtatgaaatacgaccccgagataggtatcttcggaatggacatcaacgtggtcctccgccgcaagggcggagcccgcaacgagaggagagccctcctgaagaccaggatccccaaggagcaccgtgtcgacagggacgaggccatccagttcatgaaggacaaatacaaggttgaggtgatccagtgaaacctaagaaacagtatggcaggcaggtcggatgcgaccgctgcggacgcaggcgcggaattataaggaggtacggaatgcacctctgccgccagtgcttcagagacatggccccggagctgggcttcaagaaatactcctgaggtgacagaaatgcagagcgatccacttaacgatgcaatgtgcgtcataaaaaacgcgtcgaccaacggaaaggcggagtgcgagatcgcaccctcctccaagctgatcggccgcgtgctcaaggtcatgcaggaccacggctacatcaaccagttcgagtacgtcgaggacggaaaggccggaaagttccgtgtaatgctgaagggagccatcaacgactgcggcgtcataaagcccaggtactccgtgaaggtatcagacatcgagaaatacgaggcgaggttcctccccgcccaggatttcggtgtactgatcttcaccactaccaacggtgttgtcgcccaggaccgtgccaaagagcttggcatcggcggaaaactgttagcgtacgtatactgaggaataaagatgacaattgcagggataatcgaaagccacatcgccatacccgatggggtcaccgtcacaatggacgggaacaccttcaaggtcaaagggcctaaaggtgaactgagcagaaacttctcgcacccccgcgtcgacgtcgtcgttgcagacggtaatgtcacagtgaaatgtgagtatccgaggatcaaggacaaggcaatgatcggaacctacgccgcacatgtgaagaacatgttcaagggcgtaaccgagggattcacctaccatctcaaagttgtcttctcccacttccctatgaaagtagctgtcaacgagaaggagaagagggtagaggtcaacaactacatgggagggcatgcaacccgctatgccgccatcgttggtgacaccaaagtaaagatctccggacaggacataaccgtcaccggaatcaacatcgaggacgtcggtcagaccgcagccaacatggagaagtctaccatgaggcgcggattcgacaagagggtcttcgaagacggaatttacataacgctcaagtctcacaaggtgaaagaatgaccgtgaaagagttcaaggaccttccggggttcaaggatgcaaacgttgccgagctcgagtcgatcggaatcaccaccgtggaccagctgaaagaggccgtcaacgacaaggcgaagacgaaggaggtcatcaagaccctgtccggagtcggacccaagaccgtcgagaactggcagaaagcatttgcatccaacgaggcccccaaggcaacgaaggtagcaaaggcagagaagaaggagcctgcggcagaggccaagaaggaagaggagaagaccgaggtcgtagaggccaacgcctacaccgtccagcccaagcccgagctcgatgaggagaccgtcgacgcactcgccaagagggctatcatttctggaaagcgccccgccttcaagaggcaggagtggttcagatacaagatgctcggcgagaagtggaggagacccaagggaatccactccaagatgaagaggggcctcaagaggcgtccccccatggtggagatcggatacggcggacccgccaaggcgaagggactccacccgtccggattccaggaagtcctcgtgtacaacgtcgacgacctcgagaacatcgaccccaagaagcaggcggtccgcatcggcggaaccgtcggaacaaagaagagaatcactatcgaggaccgtgccaaagagctcggaatccgcgttctcaacaggatggtgtgataaatgtcagaccttagaaaccagaagaggatggcatccgagatcctgaagtgcggagtgaacagagtctggatcgaccccaccaaagaggacgaggtccaggagtgcatcacccgcggcgacatccgcaccgccatcgactccggcatgatcaaggccaagccgaagtccggcacgtccaggggaaggataagatacgcagccaaacagaaggccagcggtaagcgtaaaggacctggaagcgtgaagggaacagcaaacgcacgtgctcccgcaaagcgcaaatggatccagaccatcaggcctatccgcgacgagctcaagcagctccgtgcagatgggaagatcagcccctccgtgtacaggctgtactacaggaaagccaagggaggatcctacacttcccgcaggaacttgaagcagcacatgatcgctgatggcaacctgaaagaggaggagatctgatggctacaggacctagatacaaagttgcgttccgcagaagaagagagggccgcaccaactactacacccgcaagaagctcctttcgagccacgaggtaagagcagtggtcaggaggtccaacaagaacatcaccgtccagttcgtggatttcaccatgggcggagatgtggtcctcgcggcagcagacaccaaacagctgaagaagttcggatgggagaactcctgttcctccatccctgcagcctacctggttggatatgccgcaggcctcagggcaaagaaagccgacatcgagtacgcagtgctcgacatcggtatgcagaacccccagcacggaggagtgctcttcgccgttgccaagggaatgatcgatgcgggtctcgagatccccgttagcgaggatgtcctccccgatgaggacaggctcaacggaaagcacatcgatgacaagatcgaagctgacgtaaacagcgttaaacagaaactggaggctgagtaaaatggtcgactgggtacctaagacgaggctcggacatatggtcctcaacggagaggtcacgaccatgagcgaagctctggcgaccaagctgcctctgcgtgagcccgagatcgtggacattctcctgccggaccttcaggacgaggtcatcgacctgaacatggtccagaggatgaccgactccggaaggagggtcaggttcgccgtgacctgcatcgtcggaaacggcgacgggttcatcggtgtcggaagggctaaaggaaaggaagtcggaccttccatcaagaaggcaatcgacaatgccaagctcaacatcatcgagatcaagagaggatgcggatcctgggagtgcggatgcggtactgtgcactcgctcccgttcgaggtaatcggaaggtccggatccgtcaccgtctgcctccgccccgcaccccgcggtatcggactggcagtcggcgatgtcgccaagagccttctcaccctcgcaggtgtacacgactcctggggattcgccaccggaaacaccaagaccaaggtcaactactgcatggcgaccttcgatgctctcaggcagaccgctaagatcagggtcaccgacgagcaggcggagaggctcaacatcgccaccggccccgtcggactggcaggtgctgacgagtctgctgacatcgacgagcagagggaggagtgaacatgtgcgcatacgtcgtaatccgtgtactcggacaggccgatgtcgcacgcgacatccgcctgaccatggaacttctcggactgaacagggtcaaccacgcgaccgtcatccccgagaacgccagctacaagggaatgctgcaggtcgtcaaggactactgcaccttcggactgatcgacgaggagaccctcgccgccatgctgaaggcccgcggaaagatcgtcggcgacaagccccttaccgatgaatatgtcaaagagaagaccgagttcgccaccatcgacgacctcgccaaggccatcgtcgccaacgagtacaagctcaaggatgtcgagggtctcaagccggtcatccgcctccacccgcccgtgaaaggatacgagggcaacaagcgctccttccagaacggcggagcactcggaaacaggggagacaagatcaacgagcttgtcaagaggatgctctgaggtgacataaatgccaagcagaactaagaaattcagaggatccaggacccacggacgcggaaagaaatccggacgtggagccggtataatcggtggccacggaaacgctggtatcggaaagaccggaaagatctggatgctcaaaaacgacagggaccactatggacgccacggcttcaagaggccgcagtgcatggtgaaggcaaactctacgatcaacgtgtccgatctcaagaagagcatggacaggttcgtcgcagaaggctttgcaaagaaagacggagagaagtacaccattaacctgactgacgccggcatcgacaagctgctcggcagcggaaacatcgacatcgctgtcgatgtcaccgttgccgaggtttccgctaaagccaaagagaagatcgaggctgcaggcggaagcatcgccgagtgatccgaaagggagtaattccgatggatgatgaaaaaccgagcctgttgtacaaggtaaagcccattggcgacaggctccccgccgtcaagcgtcctgaagggcacgtgcacttcaggaccaagatgatgtgggtagcagtcatcctggtactgtacttcgtgatgtcgaacgtctatgtctggggactcgatcaaagcgagtctctggacatattcgcccagtataggaccatcatggccggggcgtccggtacgatccttcagttaggtatcggaccgatcgttaccgcttccatcatcatgcagctgttcgtcggagcgaagatcatcaagctcgacttgagcaataggaaagacaaggcatgctaccagtctgtactgaagctcctggtcatcgtgatgatcttcgtggaggccatacctcaggtattcggctatctcgttccctcggacacatttacagatacatttggaagtgtcggcgcaaaactgctgattatcctgcagttgttcgtcggatcctaccttgtgttcctgttcgatgaagtcatatcgaaatggggtatcggcagcggtatctcgctgttcattgcagcaggtgtatcgcaggccgtgttcacaggtgctttgaattggtatgcggtcgacaacagttcggccatgtccctgtccaatcctcctgctggaacaattccaaaggcgatatacgttctcatgaacaccaattccgccgacatggcgaacggtgggtatgagatgatattcctcgggcagcctaatccgctgatcgctctgatcggaaccatcgtgatcttcctgatagtggtctatctggaatccagtcgtatcgagcttccgatatctcatggaaacgtgagaggtgccagaggcaagtatccgatcaaattgatgtatgcaagcaacatcccggtcatcctgatgtccgccttgctggctaacatcagcatggtctgtctgctgctgtacaccaatgacttcctgagcggaataccgttcctcggaggaaacgcatccatcggattctacgaagacggaagtacgaccgcttcgtcgggattggcatggtatctgtccaccccatcgggtctgacggattggctgttgcctatcctgaatccatcgagttacggcaacgaccacactgtactccagaacatatgccatgtggcgatctatatggccgtgatggtcctcggatcgatcatgttcgcgaagttctgggtagagactacgaacctcggtgcggaatcggtagcgaagaacatccagcgcagcggtatgcagattcccggattcaggagagaacctcgtgttctcaagagagtgctcgacagatatattccgacgatcaccatcctgtccggagccttgatcggtctgctcgcagcctgtgccgatatgatcggtacgacaggaaacgcaaccggaaccggtctgttgctgacagtaggaatcatcatccgcttctatgaggccctcggccgtgagcagatgatggagatgaaccccatgatgagagggttcttcggaggagaggagtgataaacaatgccaaatccaggcagtcccgaacagatgagacagatgcagcaagatatgccccagatgccgaaaggcaccatgatgggcatgcttgttgtcctgctcataatgatgatagtcatgcagttcagggaggctatcggaaaggccctcaacgtcgtgttccagtacatcgacttcgggggagagtatccggtccttaccctggtcatcagcggagtgatcatgatcactatcagcaccgtgatcagggcatacatgtccgatcccatcggtcaggcgaagagccagcacatccagagcgagttcagcaaggaaatgcgtcaggcaagacttgagaacaacctctacaagatgaagaagctccaggaagcccagcctaagatcatggccgcctccatgaaccagcagaccaccatgatgaagaccatgccgataaccatgatcgtcatccttccggtctatgcctgggtatggtatttcatcaacgataccatgggtggtgcggatatgagcatctggatcaacatgccgtggggtttcgcagacctcaacagcacgatctggttcatgcccgtgtggatcgtcatctacaccctcatcagccttcctatcgggcagctcgagaataaactggtaaactacatattcctcaaaaaacgccttgaggaaatcaacaagggtgtacaatgaggataacaatcagtggtcctcccggttccgggaagaccactgtctgtggcaaactctctgaagaattgggccttaaggcaatcgtcttcgggcaggtgttcagagagcttgccgcagaaaaagggctttctctgggagagctcggtgctcttgcagagaaggacccttccatagatgcgggcatagatgcgaagatcgtcgacatcgcacgtgcccatcccgatataattctggaatcgcgtctttccgcatacatgctgactcggaacaacatacctgcattgcgtgtgtatcttgatgccagtcccgaggtcagaatgtccaggatcggcggacgcgagggtaaggaccttgagatcgcggtcaaagagaccatagaccgccaggcatccgaggccaagcgttacatgatgtattacgacatcgacatcgacgaccggagcgtctacgacctggtcataaacaccgacgaattgacccccgatgaggtgctggacaggatcctttcggcggtccgtgcacgaaacatgctggtcaaggaccctaaagccataccggataagtggggaaaacgcccctccgaccgtaccatcggcgagcttctgcaggccggggtcatcgcattggacaagccgtcgggccctacatcccatcaggcgactgcatgggtcaaaggtgccatccatatggataaggtgggtcacggaggtactctcgacccatatgtaagcggcgtattgccgatatgtacaggcaaggccgtccgtctcaccgatatagtcctgtcttccgataaggagtatatctgtcttatgaggctccatgccgaccgttccgagaaaaagatcagggaggtcatggaccggttccgcggaaagatctatcagcttcctcctgtaagatccgccgtcaagaggcaactcaggatcagaacgatcaaggaactggagatcctggacatccgcggaagagacgtcctgttccgcatatcctgcgatgctggcacatatgtcaggactctgtgtatcgacataggggagatgttgctgtgcggtgcgtccatgacggagttgaggagaagcaggtccgggaagatgacggagaagaacgccgccaccctccaggatctgaccgatgcatacatcttctggcaacaggaaggtcatggggaatggctcaggagtctcatcaggccgatggaatgtctggtcgatcccctccctaaaatcatcgtcaaggcgacggccgtggatgccgtctgccacggggcggatctcagcatcaaagggatccacatgctcgatccggatatccggaagaacgctttggcggcgcttatgaccgccagaggagagcttgtagccatagggaagatgcagatgtcttccgagaagatcatggccgccgattccggtgtagccgtgaaggtgacgcgcgtcctgatggatccggggcactatcccaggatgtggaagtactcaacagacatagaatgtcttcccgactcgcaataagtcttttttagtgcaaggtgtatccccgcccgatgggaatcttttcgaagaacgagacattgctgacgcttgatgccgtccatgtcggagaggtcgatccgaccaatgagactggtacaggctacaagaatgtgatgacgtattcgttcgacgtatccaaaaaccgcatgatccgtgcccaggtaaaatcggatgcacccatagacgtggtcatcgccaacgaggacggctctttggcgggacatcgggaaggtgtgaccgacgacgtcgtggggccgttctccacttcgaagaacgcctccatgggtctgatactgggtctatatccgggtgacaaggccacggtttccgtcaaggtatggacggacagcaaatgatgcgcattgaagacggtggcaggcacagcttctgggctgatactctgcccgcaggaatttcggttatgcgctcgttcgacagaacggtgctaatagtatggttattgtctctgatcgcgagcgtcgcagctttgggttatatgatgtccgccacggacatcgacacctatgtcgccatacaggtattggccgccccgttcatattggtcggattcctgtacatggtgtataggaagttcctgataccgatggtggcggtgatagtgctggtggccgcattgtggctactcgatgtggatagttccacgatcctcttcctggctgagataatattcggtgccgtcggggtcgcatgtgtcgtcggcgtgttccagaggctcatattctacaagacccttcacatcatcagatacatcaatgtgaaggagaaactcggtttcgtcgacagggccgtcgctttccttttcaacgtccctccggatctggacaccaggaacatggaggtcgatttcaatcaggtgggcaagaaattcccttggaaggacatgttcagcaccgtcatgctgtccatggccgtaggtctgttcgtctggatctatttctccatgaaccctgctctgtcggacctcgacctcaccaaggcttccctgtccgtgttcacggtgatattgtatgtcccggtgatcatcctgccgttctccgtgttcaagtccatgaatgcgaggatcgggaccaactaccgcgatttcaagctctacaacggagttgtcgcgaccatccagaggatggccgtgccggtggtggccgtcttcctctacctgttctacaagatcggtaatgcggaggatgtgatggtcgttatgaaattcatagctttgtccgcagggaccatcttcctggtgaccctgctcacctccctgctctacttctacatgatggaggcctctatagtatcggacatagggaagaaatggaatctgttcatgcccgtccccctcctcatgagcctcaaggatgaggatcccgaggacggttcatattatccggccacccccgagagggacgaatcggatctgggcgatatcgagatagccgtccgtgaatgattttgtacggcatgggccgcctttctccgcggtccatgccggaaaccgttcttcgtcactcgctgtagaagcgggacatcgacgggtttgcccttccgggggcatcccagccgtagattatgggtttgaagacctccatggacgacattcccggggtcttgtggaggccgatgatctccggctccctgttgttgcttatgacgatcttgtacttctgttcggtctcgtccaccattatcgcaggtttgtcgaaggccttcagggaatccaggacgacgtcggccatcagctgtatgtcttccggtttcaggtcgtccggtaccctcaggatgaagcagctctcctcggtctgcccgttgagcatgaactccacctcggtcttcttcatgaactccttgaacttctgtcccttctcgtcgtccttgacgagggccagcaggttcttctgaaatttgtaggggatgtccagataaagggcgtcctcaccgagtatgttccacatggccgagagaatgcgttaacgggtaaataggagttcgcatacccagtatccgttaatcccaaactaaaatttaatctacgacggatatatggagttccaatggccgaggatttcaaggtcaccccctgggaggtgaccggagacattgattacgacgtcctgatgaaaaggttcgggacgacccccatcgatgaggcgatgataaagaggatcgccaagtacggggaggtgcaccctatgctcagacgcgggatattctactcccatcgcgacctcggctggctgctcgatgagtatgacaaggggaacagattctacctctatacggggaggggtccttccgggaacacccatctgggtcatatgatgccctggatattcaacaagtgggtccaggatacgttcaaggtcaagatgatcttccagatgaccgacgacgagaagttcctgttcaaggacctgaccctccacgatacgagggacatggcctacgagaacgccttggatttcgtggccttgggattcgatccggacaacacgaagatcatcgtcgacacggagaacatagacaggctgtatccgatcgccctccgcgtggccaagaaggtgacattcagcacggccaaggatgtgttcggattcgaagggtcctccaatatcgggaagatattcttcaccactctggagtcggccccggcgttcctcccgtccgagatcgaagggaggccgactccggtggtggtgccgtgcgggatcgaccaggacccgcacttcagggtcactagggatgtggcccccggactcggatatcccaagccctccatgctctactgcaagatgtgtcccagtctgaacgggggcgacaagatgtcctcgtccgacgagatggccaccatatacaccaccgatacgcctaagcaggtcaagaagaaggtcgggagggcgttcaccggcggatgtgtcagcgtggaggagcagagggagaagggagggaaccccgaggtctgtgcggtgttcaaatacaactactatctcttcgaacacgacgacgccaaactcaacgagatggcggagaagtgcaggaacggggagatcctctgcggcgagtgcaaggtggcgctcacctccaagataaacgtcttcctggaggcccatcaggccaaaagggaagaggccaaggagatcgtccagaagatggcgttcgacggcttcaaatggtgattactatgaacatgaaagaggtgctcgacggcctcagctacaacgagaagaaacttcttctggcacttgataggaacggaggcaggggaagtcctgccgacatgatcgccggaggggatttctccctcgaggtggaggtcatggggtcggcctcctggctggcatccaagggtcttgccgggataaaggagagcagcgagaggtcgtatgcgctcaccgatccggaggcgtccgccaagggtcttcccgagagacatgccctgacggcgatagacgccgccggcgggaagatgtccatcggggatctggcacaggcgatccccggagaggataagatcgcggtcggttggttgatgaggaagaagctcgcctccatggcggacgaggccgggaccaacgtcctttccctgacggatgcgggaaggaaggcattgacccagcagatgcctgacgaggtcctcatagccgagatgctgaaggccccggtgtccgagaaggacgcggatccgaaggtcgtcaaggacctcaagggccgtaagggcatgatcaaggaggttgtcgagacggagagggagatctccctcacctccgacggtacggaggccgcccgctccggcatagtcctcagggaagaggtcaccgacgtcaccgacgagctcgtgcagtccgggaaatggaaggacgtggagtacaggaagtacgatgtccagacgttcgccccggcatcgtatgccgccaagaagaatcccctcacccgcctcggcaacgaggtcagggaactcttcaccgacatggggttcacggagatgtcctccgagtacgtccaacctgcgttctggaacatggatgccctgttcattccgcaggaccaccccgccagggatatgcaggacacgttcttcctggagcacccggagcatctggacctggaggacggtgaactggtggccaagatcaaggccatacacgagaacggcggcgacaccggatcctccggatggggaggggagtggtccgaggagaaggcctcccaggcccttctcaggacccacagcaccgtgagcagtatcagatacatagcggcccaccccgacgcccctcagaaggcgttctccatatccaggatattcaggaaggaatcgatcgacgccacccatctgcccgagttcagtcagatcgaggggatagtgatcgacaagaacgccaatctggatatgctcatctccctcatcagggagttctacgccaggatggggttcgacaagatccatgtgaggccgagctacttcccgtatacggaaccctccctggagctggaggtcttcttcaacgggaaatggctggagctcggcggtgccgggatattcaggcccgaggtcctcgccccgttcggcgtgaaatacccggtcctcgcatgggggttcggattcgagaggctcgcgatgctcaagtggaacatcaaggacatcagggacctctacatctccgatatcgactccctcaggaagaacacggtcttctgattcggaactggacatcccttcccgccctgatctctccagccagggcggcgaggggcgccctgcggaaatccggggccgcggtccaggcctgcttcagcagtgccaggcattccttcttcatgcctctggcgtatgctattctcgcccgcaccttcaggatctcgtcgatccaggcgccgtcgagttcgtgtaaggtctccctccctgctcttgtcgcgaactcctccgccccttctatgtcccccagacgggagagagattccgccatcaccacggccgggaggactcctcctacctattccatggcggaaccggcgcattccgcggaactttggaaatcccccgtcatcagctatatctgggacattaccgtcatatgttccggggattccagtctcctgagtttctcggccatctccctggccttcttgaggtccctgcagcctatggccgcttcggcacacagccatgccatgttacgttccaaaccgctctcgggcctgatcatggagagggattccaacaggtcgtcgctgggagagaacaggatgtccgccttcatgcgcatggccagccaattggcctccagattccttcccgactttatcaggtgaaacagcctttcggaacgttcccccttatccagccagtagtccgcggcccagctgtgccatctgcgcaggcttcccctgtcggccttggacaggaacaggtctgcagtctcccgggggatctgggtcattccgttgtagtccgtgggtatgacccctgtacgggtaggcgggaggtcgttcctcggtatcggtgcacgaaggatgcacgcctttccgaaagtctccctgtcgttgtggctgagtgacctccacttcgtctccgggtcgcagcgcttcatatccagcagggcgtcgaccgtcatgccggccttctccacctcgtctctgatggcggcggcctcgatggtgcccttgggctgcagcgcatagacgaacctcttcgtacgcgagcccttcaggtgcgcctgccatccgacaacgtaatccagttcgatcagcttcttcaggtcgatcgatacgtgtgcgcgggttattccgacgaccgatgcgatcccgtcctgcgtaaggtcgaacgggattgtgtaatcatcaccaggatagtatcccgggaatctcgatagatgcagcattatcctctgcttgactgtcacatccgtagcctttcctatcttcatattcgataaaaaaaccagtgattttaaaagacatagtactacatgtaggttccagaatatcgaaaatcaggaagcctgaaccgtgtccagaagattgatcgtactttgtaggaaagatatatcatcagttaatatagtaaaacattacatatcctgtaggcgttgggaagacctcggaaacgacggttatgccgattatacaaggtgcggggatgacgtggtgatgtccattcccgatcttcatatctattctgacggtctcgatgcccgggcgagggctttcggcttcgatccggatgttgtaatctttccatcggaacattcctcgtcgagcgggatgcccgcgctcaccgtccaccccatcgggaactacaacggttcggatctgggagggcgccccaacaccttggtgaaggcatgtccgtccatgatgacggatgccctccgtctcatcaagtccaagtgctccttggatgagttcaacgtgtgttttgaggccacccatcacggtccgtacctggagactccggcgttcttcctggagatcgggagtgacgaacgccattggaaaagggacgacgccgcagaaatccaggcatccgtcctccgggacgtcccggacagcaacggctaccctgtcctgatcggtctcggagggggtcactacgcccctcgtttcaccgagctggcactttcccgtaaggtgaatttcggacacatgctcccgaattatcagaccgaaggacgttccgacgaggagatagcgacgatgataaggaatgccgcggaatgttccggcaccaaggtcgcgttcctccacaggaaatcaatgaacggacccagtgccgcaaggctgacctcgctggccgaatcggtcggctgcgaggtcataaaaagcgattgtttcgagccgctcgacgggaactgatgtgggtcccggagaagggccgtccgaggatggccttctccagctcctcgaggttccttccgtcgacgatctctatgtcgatcccgcacctttcggcgatctgcacccctagagggtcgaaaacactggatttgccggccccatggtcggtatatacgatatgtcccagctgttcgatggtgaggttctcgtatctctcggcatcgggattcttccgggggtcctcggaatatacggcgtccacggatgtggcgttcacgacgcgggtcgcacccatctcctccgcgagcatggtggcgacggcgtccgtggtgtgtcccggctcggtgccgcccatgacggcgatccccaccttctcggacatctcggccgtctccttcacggtgggtctcacatccatggtcgaggagtccccgagggcaagtgccagcagtctggcgttgatgcgggtggcgtcgatacccatcatgtccagtttatcctccgaccctccgagggcccttcctgtgttggcgtaatatctggctatcttccccccaccgcataccacggcgatgcggacggattccgatgccctcttcagcatctccgccagttttcctatgtacaccgcatcgtccttgtcggggatgaggatggaacctccgattgaaatgacaactgtgtccttatgcattcttaacccttttatagggatgggggattgggataaaatcattgttgaggtttcaacatggcaaacgacaattctgtcagcagagcacgctatgactttaagaaagccatggaagagatcaagaactatcgaggaaaaggcaccgagctgatctcggtgtacattccgtacggtaagctgatctccgacgtaatggcttacctgagggacgagcagtcccaggcatctaatatcaaatcgaagaccaccatgaagaacgtcaccggtgcgatcgaatccatcgccgcccgtctgaagacgttcaacaaagtgccggagaacggcgtggtcatattctgcggagaggtcccccgtgcgggagaccagaccaagatggtgcagtatgtgatccagccgccggaatccatcaccgcattcctctacaggtgtgactcctccttcttcacggagccgctggacggcatgttggtcgacaagaggtactacggactcatcgtcatcgacaggaaggaggccaccatcggaatgctggccggtacgaggatcaaggtgctgaagcacttcgattccctggtcccctcgaaacaccaccagggaggacagtcgtccgtccgtttcgagaggcttatcgagatcgcggcccacgagttcttcaagaaggtggcggactcgtgcaccacctgtttcctcgacgacatcctggacatggaggggatcctggtcggaggccccggtatgaccaaggagttcttcatcaacaacaactacctccaccacgagctcatgaagaaggtcgtgaagcccttcttcgacaccgggtacaccgacgagtccggactgaaggagttggtcgatgcggcccagggcgccatcgtggatatgcagataacctccgagaaggagatggtccagaggctgttcagggagatcaggaagacggacggaggactctccgcatacggagaggacatggtccgccatgtggccgagttgggagccgtcgacacgttcctcatctccagcgagctgaggaaataccgtgcgaagtgccagtgtcccaacggtcaccagttcgatatgacggtggacgatccggacgccgatgtcaaatgtcccgagtgcgggtccaatgcgaaggtcgtgagcagcatggacctcgtcgacgacttcttcgagatgtccgaggcgtacaactcgagcatgcagctcatatccggggactcggaagagggggagatgctcctcagggccttcggaggtatagccgccctgctcagatacagggtcgagtgattccaatgaaagtacaggaacagttcgagaaggaatgcgaacaggcggtgcgctcggccttggccgacatgggagcccccgccgatctgaaactcgtcaaggaggtccccgacaacgcggacctcgccataccctgtttcacattgtcgaaagccctcaggatgccgccggtggccatcgcggagaagatcgcggagaagatcgagaccccctgcggcctcatatcctccctctccgccctgaacggctatctgaacttcacagccgacagcgaggccgtcgtgaacgacgtcctggaggagatcagttccaggaaggaggatttcggaaagtccccgaagaccggcataagggtcaacgtggaacacacgtccaccaaccccaccggtcccgtgcacgtcggaagggccaggaaccctatcatcggggacaccttggccagatgcctgcgcatgcgcggacacgatgtgaccaccgaatactatgtcaacgacgtagggaagcaggtggtcatgatgtcctggggagtggccaatgtgacccccgaggaggtccagaaggagatcgaggagaccgagaaggcggacgacaatccgaaggtggatcacaggctcgtctacaactacagggtcgccaccaagaagatccacaacaacgcccctatggaggaggagatcgcccagatgctcaggaagttcgaggcgggcgacgccgagaccatagactatgtgaagaatgtggcggagacgatgctgagcggtataaacgccaccctcgcggacatcaacgtctccctcgacagatacacctgggagtccacgttcataaagaacggtgccgccaaagacatcgtcgagaagctcaaggccagcaagtatgccggccaggaggaggacggcgcatggtacgtcgacctcaaggacttcggcatccacgggaagaacaccaaattcacattcacccgttccgacggcaccaccctttatacgaccagggacctcgcctaccacgaggacaagttcacccgttccgacagggtcatagacgtcctgggcgaagaccagaagctgggttcccagcagctcgtttccgccctgcagatcatgggggaggagaagaagcccgaacctctgttctatgcattcgtctcccttccggagggcaggatgtccaccaggaagggggtcgtcgtatatctcgacgacctgatagacgaggccacggacagggccctcaaggcgatcaaagagggtaacaagtgcaaagacatgtccgaggaggagatcatgaggatcgccaaggacatcggtgtcggagcggtcagatacaacatcgtacgtgtcggtgccgacaagcagctcgtcttcaagtgggaggacgccctcagtttcgacggcaattccggaccgtatctccagtatgtctacgcacgttcgtgcagcatcctgaggaaggccggggatttcaagagggacacggacggttccaagctcaccgacgaatacgagataaaactggccaagaccctttccaagttcgagtccgtcctcgccgacatcgacgccaccaagagggtcaacatgatgccggcctacggtcacgaggtcgcggcggccttcaaccagttctatgcccaggtgccggtcctgcaggccggttccaacagggatgcgaggctcaccctcgtcgagtgcaccaagtacgtcctcggcaacgtcctctggtgcctcggaatgggtgctcccgaggcgatgtgatggaattccgtcccatgaaactcaaggacctcaggaaggtccgcgaactggagatctcctgcataaaggagtacttccaggagaccatcgagaacaaatgggacgaccttccgcaggagtggaaggacaacctcggggccagcagccccaaacatttccgtccctacctcgacagcgggctaagcttcgttgccgaggaggacggggagatctacggattcatattcgcccagatgctccaccatgtggcggactgcgacaatctggtgtggatagagaacatggccgtcgacccgcttgtccggaggaacgagatcggctacaggcttctcagggagacccttcgtgccggacaggcgcagggtgcggacgtagcccacagcatgatctcgccggacaacgccccttccatcatgctccacaagaagatcggtttcttcatggaccgccgcatggtggcccttatggacctgaaggatccgaaactcaaactgtaatgtcggatccggtactgtgcgactatcgtcccgcatgtgccgtccgggacatctggcatattattttttaaaaagggtaagtggtttgtgaagacggaggtgtattcactcctctttcttcttgccggcatgttccagtgcggcctttgccttctcggtggccctggtgatcagcatcgtcgcggcgaccgcgatgacggtgacgagcagagcgtagatggtgagacccagaaggtcatcctcggattcgaagatcgcggcgatggcctgtttgatggtctcattccatgcgagagctgcgaccagtccgaatgcggacacgatcagagcagacagagactccaggaactgaattttgaaagattcagccatggttggcattcacttatgcatgtataaatataaatttcggtaggccagatgattctttggaagagattgtgtgaaaaagaggcccccttccgggggccggaagacgtcacttccttctggaggagacgtatttgattttcttggaagagtcggacggcttggaggtcttcttctcctcttccagttcggtgaaggaagcggccttcttcttctcctcgacctgtacgggggcgggtttggattcctcggtcttcgccgcggagtcgttggctttgctgttgtaccttctcctctcggttccgacgctctttctggcgggttcttcgggcttctccgccttcttcttctcctccaactcggtgaaggtggtggaaggtgccgccttgggcttggtgcggatgtagtagaacgccgcgatgacgacgatcaggacgatcgcgatcagtgccagatacgtggtgacgttggaccagatggatttggccacagagatgttgagggtgaagtggttcgcacctgcatcgaacgtcgcatcgtccgacgatgccgtcacggtcacggtgtggtcgccgtcgcccatggagaaactgatcttcacggtgttctgaccgtctgcgagcgtctgggtcatcgtcacattcgccgcggtgctctcggttatgtcaccgtaggcgatatcgacgtacaccttgaacgtggcctctatctctccgcccgtatcgttgttcaccaggaacgttatggtgccgtccttcccgtccttgaattcccctgcgctgccggtcgccatgccgggcgacgcatcggagccgtcggagacgaccgcggaggcggtcacgagggccataagggccgccaggaggaacacgatccccttctttccggacatcatgtgatgatctcctcgaggcgttcctgctctatggccttcctgacctccatggagagcctccttccggtgctcatgttggtcctccacagggtgtttccgtacgggtgtccgacggacatgtggacgttggtgccgcctccgatcctgggggcgacgtcgtagatgtagaagttcaggtctttgtcgacgcaggtctgcaggcagaacggtccgatgatcccgggcttgtagtactgctgcgtggccttcacgtatttctcggccatctcgaacgccttgtcgagaagggactccctgagggtggcggagttgtgtccgcatacggtgtactcggggatgatgccgtcctgctccagttccacctgctgtttggcggggagcctgacgtagccgtcgagggaggactcgaacctccagtcgataccgaggagctccaccttctcccccttctcctcgagcgggtcgtagaagaagtcgaggttgaagacgggaccgatgatgtactgctccatcctggcgtgtttctcgaagtcctcgtcgaggaccccctgcctgatcagctcctgggatttctccacgtattggtcgtagtccttggcggtgaagaatcccctctcgagcttcttgacatggtggtggaccttgattatggtcagtccgtcgatgtcctcgggtttctcgatcttcttggggtaggggaggttggccttctcgaggagccagtagtagtcctgggggccgcccctctcctcggacctgaggaggttcctgctgccgaccatggggaccttgaagtcgttctccacctggtcgatgctgcagtaggaggtgaaggacctgttgggcacccacagggtgttggtgttcatcaggtactcctggttctgcggcaggaggacgtcggagaacctgtcgaggatcagggtgtcgtcgacgacgcccctgacggggttcccggaggcgtccctctgggtcctgaagtagttgttgaatgtcttctccctgcctttctgacatacggctagggtgttgaaaccctcggaggtggcaccgtcgcaggtgtcgagggcagagtgggaggcgaggactccgatcctggccttcttctggtcgtagcgtcccagattggcaagcacttcgtctctgctgatcatggatttacctgcgctaccgtaacagttgcccctatttatagggaacaatcgcgcacgcgttctaaaagactcagatgaacagtgcgatgactcccacgagcaccatggagccgaggaggtccatcaccgaggaggtgatggggatggaatggtcgtcggggtccagaccgaatttggtcgcggctatggcgacgtagtatgagaggaggctgagtatggtggtggcgaggaatccggccaccatgattatggccagggagtcgacgaacgatatgttgctgctgccgttgaacagtatgcatgccccgtaggagatgatcccgatgtagaggaaggtgatcatggcgcagatgtatatcatgaggaagtcgttggacgcccctctgggactccatttggccctcagggtacccaggtggatggccgaggacagtctggacgtgagcatgcctgacagtgcgttcccctggttcaggaaggccggcagcatgatcatcaggacgctgtacgctatgagcgattcctgctcgtcctgtatgactatccccgcccctatctcgaacaccaggcataccatcaggacggggagggactgtttgaagatccttttggcctctccggagaagttcctcttggaggtcttcctgacgaggaggacggccacgtcgacggcggtgaggatgacgatggcggccgacaggaacatcacgagctcgtcgccgaaggacagatcgtccatcttgaagaagacccaggtggacaagaatatcatcggcatggtgactatgtcgccgatggccgctatcagcggtgcggagatgttgtcgacgtcccatcccctcttgctgcccgcataggcgatgaggatgttgaaaccgaggacgatgagaccggccaggaatccccctacggtggagatgaacacaaggtcccagacgtccgcttttcctccgaagaacacgagggccaccgcccatgtggtcacacccatggcgacgctcattacgagggtgagcgcgatggccgagtcgaagttggcgcggaggacggtcccgcgtttcagactcatctcgaacgtaccgatgttcatggcggtcccgatcctgctccccatggcgccgaatatgttcccgcgcatgccgatggcggagtagatgaggaccatcatcccggttatggtcaggaggtaatcctccatctggtccaggaggagtccggcgaagaggtcggcggtaccggctatgacgagtgcggtgagacccatcgttatcgcggaagaataacgctgtatgaatttgcccgtcctgttctgtatccccgacagaaaaacaccccctcagcccatcgattatcaatgacggacaaatcattcctcttataaatggaagatgtagtgactatcaaatactgattgtgcgtaatggaatcaataaatgcctattggattagggtgaacggagttgcccagcagcgaccaagatgatatttccgatctgaagcacgtcgatatgaccgtgcgcgaacttttgaccgagatgaaggacacgtccgaggtcataatcgacctcgcctacgcatccctcatgtacaacagctccaccatggccgagaaggtccgcggactggaggacgacatggacgatctgaagttcgccacccggtacaaggtcctcctgtccagcaggaccagggaggatgcgaggcagctctcaggtatcctcgaggtcgcttccgcggccgacaggatctccgatgcggcgtccgacatcgtcagcctcctcaggttccctccagagaagaggcctttcatcaccgagatgctctcggaggccgacgagaagatcaggatgatcaagataagctcggactcgtccatggtcgggaacaccatcggcaggctgcagatcgaggccagcaccgggtgcaagatcatcgccatcaagaaccgccgcggatggacgtacgaccccgaggacgaaatgaaactcagggccaacgacgtcataatagtccgcgggaccgacgacggggccgacctcctggtcgagtatgcggccggaaggaaggaatgggagttcgaggagatcgtcccggacgatgtcatcgaggacgaggcggaggaggacctccagaacgaggaggagctctccgaggagatcagaggggagggtgacgaggaatgatgagcaagatcgcctccatgctcatggagctgaaggacacttcggagatgatgatcgatctggcatattcgtccctgctctatgacaacacggagatcgccgaggaggtcatcgccctttccgacaatctcgagagcctttccgagaggatacaggacgagatcgcacaggccgggaaggccatgccggacgaagtggcgagggccgtcgtcaccataaggctcatggattccataatggggatcgccggggccgccgagtcgatcgcggacgtcgtcataaggggactcggagagcatcccgtgctcgcgatgtccataagggattccgacacgaccatgtgccttgcgaagatcgcagacgattccgtccttgcgggcaagacgttcggcgaggtatccctcagcaccaacagcgggatgttcgtgatagcaatcaggcgcggcgacgactatatcttcgggccgggcgaaggtacctccatggaagcgggggacatactcatagccagaggtcccgacgagggtgtcgcatacttcaaggacctggcggacggtaccgagaaatccctttgatcccttttcaggagagtgcgaggccggcgtatctgccggccaccgctcccaatatgcacaggccggcgttggcgcagaagttcagaagcgccgaaccgaaacgtccgtcgtagaacagcgtgacggtctccaaagtgaaggtggacatcgtcgtgaaggctccgaagaggccggtgaacaggaggagtttgagttcctgcggtatgccggtgtaccagaatgttataagtgccagaaggaaggcgccgatcaggttgacggcgagtgtggcccacgggaactggctggaatccacgtaatgccctaccaaaaacctcagggtcgcgccgatggctccgccggctgctacaagaaggacggattccatcagacctatctccatggggatttgattcggtctcttcgatttataaatatcgggaacggcacgatgccgtccgaacaagtatgtgatgataagtggtagccccgcccagattcgaactgaggtccaaagatccagagtctccgatgattgaccactacactacggggctatctatccgccttgattccgtaatcgtttttaattgtttctgtcggtccgtcagggtgtttaaaaacagggccgtccgtcgcggtccgaagaagcatcccggatgtccccagatccccttgcggcatggaaatgctgccgtataacagaccgtggcgtgggaaaatatgcggaagtcgtttggtcggcgggcggaatccgcccgcctccgagattcactgaagtgcttccttcactttggagaatatgccgtcgatatcgccgataccgcagatggtgaccagtttcccggccttctcatagtatccgataaggggctcggtgttcttgtgataggtgtcgagcctcttcttgacggtctcctccttgtcgtcgtccctctggtagagttcggatccgcatttgtcgcatacgccctctttcttcggggggttgttggtcaggtgatataccgcgttgcaggaggggttggggcaggagcgcctctgggtgagcctgctgacgaggacctcgtctgccacatcgaagttcagtgcgaggtcgatgttgagttcgctgtcgagggcctcggcctgctccacggtcctggggaatccgtcgaagatgatgccggggacttttccgaggctctggatcttctccttcatgaggttgatgatgacctcgttgggcacgagtccgcccgcatccatgtaggtcttcgctttctttcccagttcggtgccgttcctgacggcctccctcagcatgtcgccggtggacagtctgacgtatccgagctcggtctcgagcttctctccctgagttccttttccagctcccggaggtccaagaaggacgatcatcgatttcatagcggatgcctagagtgatgtcctttaaaaggttgtccgtggacccagaggaaaaaacgagcctccccctcacggggggaggtgatttgccggggacgtccgggtatcagatgtccagtttcttgaggatgtatgcgtcgtacatcctcatgatcccggtgaaggctatcagggccccgatgactatcatcacgacatctgccgtgtcgtccagattgaggagtgcgagcactccgagggcgagcatgattatggcgatgacgatatccagcgcatgggagagggcgttccctgtgaagttcctccctatgtttatcagggacgtcgcaccgatcacgatcagggcggccgcgaggacggccatgagcacgtcggatacgagtcccggaacaagtgccagcacgatcccgatcaccacatagattatgccgggggcggcgccggccgcggtgagggtgaccttccacgcctcgtagatgtggaatacccccatcagtatgcacagaactcccgatacgatcaggatgatcttcagggaatcctgctgcagccatgcgatcaggatcccgatcacgagcatgaggatcccggagatcagggtccccttccatggattcagtttgagcattccttcagacattgactaaacaaccgcattacgaggatttaatactgtgcccgatgcgctccgtaggggcgtcatccacaaagtccgcgcgcctatgcgcatgcttataagagaaaagagaaatcgacctcgtggtaaaaatggcattggaccagaagatcattgaagagttcgagaggatcgtcggaaaggacaacgtctcgaccagccccgccgtgctgtacacctacggtttcgatgcttccatatatcacaacgatcccgaggtcgtcatccagccgacctccaccgagcaggtctccgagatcatgaagatcgcctatgccaacggcatcccggtggtccccaggggggccggtacggggctttgcggcgcggccgtcccgatagaggggggcatatgtctcgccatgcagaagatgaacaggatcctcgagatcagcgtcaaggacctgtgggtggatgtggaggcaggtgtcgtctacaacgacctcaatgccgagctcgcgaagcacgggttcttcttcccgccctcccccggttccgcggaagcgtgtcaggtcggcggcatggtcgccaccaacgcctccggtatgagggccgtcaagtacggggccaccagggactatgtcctcggtctcaccttcgtcagggccaacggagacatcgtccgctgcgggaccaggaccatcaaggatgcgtcggggtaccagctggcacgtctcatgtgcgggtccgaggggacgctgggggtcatcaccgagatcaccttcaagctgaccaccaagcccaagaagtccgcatccgccctcatcgccttcaactcggtcgtcgatgccgggaagtgcatctccgccatcatcgccaagcctctgatccccgcatcatgcgagctcatggacagcacatccatcgaggcggtcaacaaggccaggggcaaccccctgccggatgccaacgccctcatcatcgtggaggtcgacggcgagaccgacgagataatccagagggacctcaagatcgtcgaggaggtcgccaaggagcagaacgccaccaccgtcaccccctccctcgatcccaaggtcatcgccaagtggaacgatgcgaggaagtcggtcctcgcatccctgtcggccctcaagcccggatactcgtgcgtatccctcgcggacgacatgggtgtgccgatatccaaggtccccgaggccgtggaaaggttccaggcgatcaccaggaagtacaacgtcatcgtcgcggtctacggccacgcatccgatggcaacctgcataccaagatgctgctgaaggtcggagacaaggacgagtgggacagaggcatagccgccgtcgacgagatcttcaaggcgtccgtggaactgggcgggaccgtcaccggagagcacggggtcggcatatccaaggcactcaacttccaggaggagaggaagaccgagctcgactgcatccttgcgatcaagcaggccatggatcccaagaacatcctgaatcccgggaaggccgcccagtggcgcggatcccccctcaggaacctaaggtacccctgcaaggagtacatgtgaaaacgacagggcgtcatgccctgtctttatccccttccccggaccgatcccgggggaggtttttctaatactattcggaagagtcctctcaggcccaatacaacgtgggcatgagccagaagctcgcgaacagcagtaccgagatcgccaggcagacgaagtagatcttcttgtcccatgcgagtatcttggacccgtcgagaggcgggaaaggaagcatgttgaacagtgccagcgatccgttgagtgacatgagcaggtagaacgggaccacgaatgcgctgtggttgagtagcaggcatcccgctatgccgatgacggccaagaccatgttcaccaagggtcctgctatgctgatcttcccgttgtccttcccggagatgttccttccgcttatgtagacggccccgggtgccgctatcaggaagccgaacatggacatgacgagggacaggaacagtcccatcggatacatgcggtattcggaccagtaccccatatcctgtgcgacgaacttgtgccccatctcgtggaggacgaaactgagcatcaccaggacgaacatgatcaggaacataccgatgacccagatgtttcccaggtagtattcgaaatagttctttacagacccggatctgcagaacatgaccatgaacgccagcgacaggacgatgacggagatcatgatctccctcacctccctcgtactgaacctcttctgttggcccggggtgatgttcctcatattctccgagtaagggcttatgtattataagaggaacgggattgtccgcgccatatcatggcttatgtacaggtcaacgccgccaacgggaaggaggtccgcaggtggtgcgacgggtgtgggacgctcctcctggggggcagatgctccatatgcggttcccccggaagggagttcgagataaacagccccggcgacataaggccgtgcatgggcgacagcgtaggcatcctggaaggtcttctggaggaggcgttcgggaccgcggcccccatcgagaacaaatccgtattcttcaacaaggtccccggtgaggaccgtaccgacgaggtcgtggcccacgggcaggtcatcgccgtcctcaggttcgatatcgccgcggacagactcaggatagagctgagacagccgggggcggaactgttcgcccccgtggccacgaagaacgtcgtcaccatatccggggtatcaggccatctcaaggggaaagggatcgccggagagaacgtatccgatgtgctgggtcatttcgccgacggcgatccgataatcgtcaggaaggcactgaaggtcggtcccggggtggccatggccgactcggattccatgaggtccgcggagaaggccctgagggtgagggacctgaacgccccgtcggacatgcctctctcccccgatgccgaccgggataccttcgtgagggccaacagggaccatctgaaggggttggagggtacggccgtcagggagatcaggggtttcgtcaagaatgtcaggctcccggtgacggtctcattctccggaggcaaggactccctggcggcctacggtctcacggccaaggcggtcggcgacccggacctcctgttcaccgatacggggctcgagttcccggagaccctggagtatgtgaaggcgttcgcggagaagaacggcctccgtctgcatacggccgatgccaaggacggattctggaagaatgtagatacattcggtcctccggcgaaggatttcagatggtgctgcaaggtatgcaagctcggacccataacggacctcatcgcccgcgatttccccaaaggcaccgtcacatgcgaggggaaccgctcgctggagtccttctcgagggccgggaccgagctggtgacgaggaatccgttcgtccccaatcagacgaatctcaatcccgtccgcgactggtgtgcggcggagatatggggatacatatggatgaaaggcctggattacaaccccctgtacgaacgggacttcgaaaggataggctgctatctgtgcgcctcgtgtctggccagcgaatggaggaacacatcgaggatccatccggagatgtattccgactgggagaggtatctccacgattatgcgaagcgccgcggcctccctcctgaatacatagacatgggtttctggagatggaaggtcctgcctccgaagatgagacagctggccgaggggctggagctcaggatggtcccagaaggcggggacggactgtcgatgaagatgctgaagggggcatccgtctgcgtggccggagggtattcgatggaggccgtggccacggtcccccggaacagggacttctcctatgtggaggattccctgaggacggtcggggaggtgaagtactcccccgaatttgagatcgctctggtgaggacgaagtacgggcgtgcccggttgttcggcggagggcaggtgtctgtgacggcggccgatgcgcagagtgcggagaggatgttcgaaaaagcggtcaaagcactcatccgggccgagctctgtacctcctgcggcatatgtgccagatcgtgtccgcacaaggccataaggataaaggggggaatgagggtggatcccgcctcctgcacctcctgcggcaagtgcgagaaggcctgcatggtcgtccattattacgacaagatcatggccgggaagaccgctcccgcacccgaatcatgtccctcccctcgcagggtcgggaaggcccagcatgtcggagggacggtccggggggacaagggtccccgtaaagactcccgcggaggaaggccgggcggaggccggaaggggcgcggggatgcacggtccgacggaggtcgcggtcctcggacgcgccgccgtgattgataactttataagatatcgttcgatggcgttgtcatgggctcttcggtgttctatatcgcggccgcgatggctttcatcccgaccatgatcatcatgtacgttcttctcaggaagtacacctatccgcacaccgagcatccttacttcaacgacccccagttcttcatactgttcgcggtgggtctcatcgccgggaccatcctgttcctggtctatacatacataatgaacagtctggtcggagtggtcctgtatgctttgatccagtgtctggtgcttgtcgtggtcatgaacctcaagaggttcagaggggtctccgacagcatcttctacggtttcggtttcggtctcggggccggatgcgcaggagggaccgggttcatattctacatcgccaccgccacggacagcctcggggactccgtggacctagcgggttatgcattcctgttcgtcatggccctcgccatgatattccaatattccgcagtcgggataaacgtcggggaaggtatagcgcgtcacaatccgatgcagttcacagtgcaggcgatgatctccaacctggtgttctggatcatcgtcacgatagccctgttcaactccgactccgtcttcatgtatgtgatggccgtcgcggcattggccgtctccgcattctacctgtatttcgcatacacccgtgagatagcaggtctcgtgagggatgtggatgaacagaacaggaagggcagaaagaagaagtccgcctgatcaggccttgtagtgtccgtatttggtctcgtatacgatacagccgtcgagcatggccttgagcatcttctcggcgttcttgggttcgagtttctcgacgtcctccaaggtgaatgtcccgtatagttccgtcagacctttggacaggacctccatcttctcgtcgagggatgagcagtgctcgtatctatagaccagggacgaataggggtcggtgtcggatctggcacgtttcttttcgatggatccctcgaacccggtgaatctgttgaatgcggcccttatctcggcctggtcgtcggatctgaaatggaccttcatgtccttgacggggtccttgttgccgcaataggggcattcgctggtctttcctttgagttcgatgatcctaggtctgctgcatgagaagcattggactatgccgtacatcttcaatccctgtattctgcgaagacgagtgcggagatgcagcatccgtattcgtcctgcgggacctgcagttcctcgatcctgtagtggatctccccgaactcgaccccgcggattctggacatctccttcatcttcctgctcagttcttccttgagggagtccccggagccgtggagatgtccttccgccacatatcctccgtgcccgtccttcctgaatgtgtatgcgatgccggatgctatggagtccccggacctccccctcatctgggacagtacgcagaacgtgaccgctcccatggggagctcgcggacctcgacctcctccgcacccacaggtatgacggaggatactgccacgaggttctgttcgctgatctgtgcctttaatagtgctagatcgaatgcgttgaggtccgatatggggctggtcgcatagcctgacgtaatgaagaacttggatggtgtgaaactcatggggatcatccgtagatattctgggtgccgatctcctgctgtgcctgctgctgggccctgaccctgttgtctatgtcgttggcctcgttgttcagcggggtcgggtctatgttgaggttggggactatcttggagagcggcgtcagagcggtcgccgccgccctcgggtccggcagctgcgggttggcgggacagagtatgcagattatgtccttcttggagaacgtcccttcgtagagcatgatcccggtgaccccgcgaacgagcccctccttcatgacggggacgcctgtctcctccagtttcttgatggcgttctcggacgtggcggtccccagcatctcgccttcctgggacgagtccacgcgggggatgccgtcgatgcacacgatctccctcacgcccatctgttccagggtgtcgagtatgcacatggtgaggtcgtatgtctgttcgggcttgggggctatctcggaggtaacgacgaccaggtccctggccttgaccctcttgggtttcgcctcgacggtcttctcggcggccccttccacggacttgccctcctcctcggaggtcttcggagcatcccctccttccggcaaggaggtcctctcggcggaagtttcggatgccggggcggactccgccttgggtttcctcttcctcttcggcttgggcacggcgccggcgtatatccttatgggcggataggccgtgccgttctgtatcagggtgtagggcggaaggtcggcggaggacacgccggccaccacggggagcttgaggtctctggtaaggtagctcgacacgatggagcctacaagtccgacgctggggaatcctactatggctataggatcccggagcttctcctccgaatacctcatgaccctgaattctgacatcgggcacccccatgttctaaaagtattaaactgtcggtggcatggacggtgccatcatgtcagggaattccatcgaactaacgaagaccgcgggcgggatacccgtgctcacggagaacataccgacaagtgccagcgcaggtttcctcatcgccgtgaggaccggttcgagggatgagtacgacggcatctacggcctctcccatcttctcgagcataccgtgttcagggagacgaggaacatggactccttcgagatggcgaagaagatggagggtgccggaggggagctcaacgccttcacggccaaggagatgaccggtttctacggcataatcctgaaggacaccgccaaggtggccatggagtgcgtggcggacatagtctccaatccgctcatcaacgagaaggacaccgagctggagaaggagatagtcctgcaggagctcagcatggtcaagtccgagccggagacgtatgtgcacgacctcttcgagaccaacctctggaacggggagcagctgggtctcgacgaagggggtacggaggagaccgtgaagcccctgaccttcgaggacctcaggaaatattacggagagaggtacggcaggccgaatctggccgtattcgccaccggcaacgtggacagggaggaggtcgcttcctgggcggaggagagcctggacggcatgaccgcttcggtcgtgaacgagaggaaggagcccaagatgccctcggcaggataccattaccacgagaacaagaccgatcacgtcaacatcggtttcggattccctacggcgaaggtctccgaggaggagaggttcgccatatccgtcctgtcggccgtcctgggcgcggggacctcgtcgaggttgttccagaacgtccgcgagaagaatgccctggtctactccatctacgacgtggcccagcattacagcgacgccggctatctggcggccttcatgtcgtgcacgggaaagaatgtggaggagtccatgacccagacggccaagacatactccgacctcaagaagaacgggttggagaagggggagctggagaggaccaagaacctgctgaagggggcggtcgcacgcggtaccgagacgacggacagcaggatctaccgcatgtgcagggcctacatgacccacggtgtggcccacagtgccggggagacgctggcactcatagacgcggtcaccgaggacgacgtcatggccgcggccgaccgcataatcgatgcagacagactcaacgtcactgtgctgggtcattgccccaggggtgtacggtccttcgacctctcatccttggacatctgatccaggaaaccgtttatgacatgaaggaccgcacccttggccgactcttgggaggaggcgacctcgggtgtgagttcctcgctcatggtctgcatgtcctttatctcgatggccacgaatttgacctcgaggggcatggtgtcgggatccatctgacgtccgatctttatcgcggtggctatgttcacgtcgtgtgccggtacgtccgccacggtggattcgaagtcggccacgtcgaatattatgaccgtgccggggccgtattcgtatgtctgtatggcgtcgacgaagacggcgtagctgtaccctctgagaagggggagtacctctatccctcccacggcctcctggaagcaatccaccccgtcgatgcccatatcttgaaccgcctgggatatcctgaggcctatcgagtcgtccgtcattatggggctgccaagccctatgaccgctatgcgaccgttgagaaccatgtctatggggattacttctcggtataagaatcacatccagtcggggcgatgtttattattgtgcatgggtatgcctccctatggatatcaggacgaggacggagcagctcataaacgggcagtccgtcaccaaccgtcagctccagacgcttctcgccgtggcccggaccggcagcatgaccgccgccgccaaggagctcggcatatccgtcccggtcgtccatcgttatatatccaacatagaggccgccgcaggggtaccggtcaccaaatccaatgcatctggcacagtccttaccgacgagggtacggagatagtggaggcgttctccgccagcgaggccaggtgtgccgacgacagggggttcaccgtatgctgcagcccggtcacggaggacctcatgacctcggtcttctcgtccctcaagatgaccgacgtggagctggtgatctccgacgacgtccacaacgtccgtatgatgaaggagggtctggcggacctcgccctcatagacgacccgctgtatctgtacgatttcgacgaatacggatacgatatggaggagatcggctacatgggcatggtctatgtcgacaacggtccgtccttcatccgttacaagtacggcgcacagagggtggcgttcatgttcctcgactccatgagcaggaagtacagcatcgatgcggagacgtactccctctccgagatgctgggatccaacaagagcttcttcgtggacgagttccttctgacgaggaagcgtctcaaactcaagagtgcggtcgatccgaaggtcctgaggcatgcgataacggccgtattccgcacggaggaccgtaaggtcacacgcataatcaacgcgatcaagtccagacatctcgactgatgcattattttaaggtataccttataaggtaatcctaaccgcattctgccagtctctattatataggttcaggaaatttttgccaccagaggattactatggaagtaaaatacgatcccgaattcgagaagcagctcgccgagctcggcggagccgacgcaaagctgtgcttccagtgcggaacctgcaccgcaggatgcccgtccggaaggcgcacctcctacagggtaaggaagctcgtcagaatggcgcagctcgacatgaaggacgagatcatcaacagcgaggagctgtggatgtgcagcacctgctacacctgcgtggagaggtgcccccgccgcgtccccatcgtggacgtcgtcatcgcactcaggaacatggcagtcgccgagggacacatcaaggccccccacaagaagaccgccaccaacctctacaccatgggacactccgtccccatcaacgacgagatcaagaacatgaggaagtccctcggactgcccgaggtcccccctaccgtcctcgccaaccagaaagcctacgaagacctcaaggtcatccttgacgccgcaggattcaacaagatcgtggagtgatcataatggcaaaatacgcattcttccttggttgcatcgcacccctcagataccccggtgtcgagaaatccacccgtgtcgtctgcgagaagctcggaatcgagctcgtcgacctcaccgacgcctcctgctgccctgcgcccggagtcatcagggccttcagcaggaccacttggctcgcagccgccgcaaggaacctcgcactcgccgagcagctcggtctccctatcatgaccatctgcaacggatgctacggatccctcttcgaggccgcccacgagctcaacaacaacgccgaggagctcgccaaggtcaacgagatcctcgccaagatcggcatgcactacaacggaaccacccaggtccaccacttcgcagaggtgttctacaaggaggtcggcgtcgagaagatcaaggccgcctgcaccaagcccctcgactacggaatcgcaaccttctacggctgccacttcctgaagcccggagacctcaagggactcgacgatgtcgaggaccccaagatcctcgacgagctcgtagaggccaccggctgcaagagcctgcccaggaagcagaagaccctctgctgcggatccggtggaggactcaaggccgccttcggagacgtcgccaaggagttcaccaagaccaacctcgagaacatgcaggcctccggtgcccagttcatcgtcgacgtctgcccgttctgccacctgcagttcgattcctccgaggaggcccttggattcaacatccctgtgctgcacctcagccagctctacggaatcgccatgggcatgtccgaggaagaactcggtctctccgcccacaaggtccctgtaaagctctgagtcgggctacaaatcatttagagggctccggccctctttttcatctcgagcataccggccgggcggatccgtttccgtccggccacccttgtatcttcttcgggtccctcccatatattttttagtttagccgaaactcgagaaatagatatatactagcggtaccagtataagtaggaatattttgtatatttaggtgaaaattgaatatgctggctattagtttttatcagcattcctaaattattcggtcccgacaaacctatttatagcgtaacctaatcctccgctcagtaatacaaggagctacaaacatggcagcacccggagcagagaagagggacgcggcagccaccgcagcgcccgcagcgcccgcaaaagagaccaagaaatcctccgcgcccaagaccgcaggagcgaggaagagcaaggacaagtggaaggccaaggagtggtaccaggtccacgccccccgcatgtttaacgagaccgtcatcggagagaccccctccgccgaccccgactacctcatcggaaggcaggccgaggtcaccgtgcaggatctgactggcgacttctccaagatgcacatcaagctaaagttcaagatcgtcgagaccgacggccacgaggccaagaccgagttcatcggacacgacctcacctccgactacgtcaggaggctcacccgcaggaagaagaccaagaccgaccacgtcgtcgacgtcgtcaccgcagaccgcttcgtcctcaggatcaagaccatgtccatcgccgaccgcaggatccaggcctcccaggaggatgcgatgcgcggagtcatcaaggacttcctgatgcagtacgccgctcagaacaagctcgcagacgtcgtcaaggcgatcatctccggcgacctggcaaaggataccgccaaggcatgccacatcatcatccccatcaagaggatcgagatccgcaagtccgaggtcctcaggaagggagagggcgagcccgagtccatcatcgaggcccctgccgccgaggagcccgaagcagaggagcccgcagaagaggtccccgccgccgaggaagctcccgccgagaacaccgagtgaaaccgtaaaatccaacgccgcgggcaaaacccgcggctatccatcaaacttttttctggcatcattccaatagggttataaaccacaagtggatgtgccccaataaagccgggatggctcagcctggtagagcgtcggactcatagggtttggtttaattactgacctcaccagggaaatccgaaggccgagggttcgaacccctctcccggcaccatatccttaattcttgtgcattgttgttcacttctgcgtattccatcgccatcgatcgaagcatacgttgtaatagagtctggctgtcacatcgggccgggtgttatattaaaatcctaattgactaatctacccttatcatgaggctaatcatctataacgggaaaggaggagtggggaagacttccgtctccgcggccaccgcactccgtctggccaagatgggccatcgtacgataatcatgagtgtcgataccgcccactccctcggagattccctggatgtcaagatgggttcggacatcgtcaacgtggcacccaatctagatgccctggagctcgacatcatacatgagatgaagaccaaatggtccgccataaaggactatctggaggcgttcatggtctcccagggtctggaaggcatcaccgccgacgagatggccatcatgccggggatggagatggtggccgctttgctgtacgtcctcaccttcaagaaggagggcaaatacgacgtcgtgatcatagataccgcgcctaccggagagaccctgaggctcatgagtttcccggacgtatccaactggtacatagacaaggtcttcaccatcctgagcaagttcatgggcatcgcccgcatgaccatcggccgcatggtggacttccccctccccaccaaggaggtcatgaacaccgtgatggagctcaaggaccagatgaagcagtgcaaggagatcctggaggattcggagaacacctccatccgtctggtactcaaccccgagaggatggccatcaacgagacccgtcgttcctatgcctacatgtgtctctacaacaagaacgtggagtgcataatcgtcaacaaggtccttccggacaccgtagacggggagttcctgaagaccaaactggaggagcagaagaattatatgaggatgatagcagagtccttcgatggtctgaaggtgatgaacgcctacatgctcaacaccgagatcagaggcatcgagaggctggagggtctggcggacatgatcttcggcgactccgatcccatagagacctacagtaccgaaagccctatgaggttcaggaccgccaaggacgggaccgtggagctggtcatgaagatgcctttcgtgacccaggaacaggtggaactttttaagggcaaggagaacactatcataatccatatgggcagtcagagaaggaccgtttcccttccgacatccctctccggagcggagttgttgggggcggaattcggagacggctgtctgatcgtaaggttcaggagggaatgagaatgacggacgagaggaaatacgacgacccggacatacagaagttcgcggaagagaacagggagatgatcgagaagctcctggcggaggagaaggccagacaggcgaagatcgaggcagaggcgagggcacgcgcggaggcggaatacatcgccaaacgcaacgcccagcagagatacgaggatgccatggcgcgcgaggaccgtgcccgctatgccgccgaccgcatggagtatgcggcccgcgatgcgggggagagggcctacgacacctaccgctatgcccgcgaccgtaccgccgacgccatggaggaggggagggattatgcccgtgctttcgtccgcgaccaggccgactacgcctacagggccgcccgtgacgagagggaccgcatgagggcccgtatggaagaggagaggcgctacgcctacgacatgatggacgagagcagggagaggttcagagaggaccgcgagagggccaagaggtacatcaacgaggatatatcagacgccctcgggttcttcgccgaccccaagttccagcagcatctggtcggagcgggtctcgagatgtggatggcactcaactccctggtgaggaacagccccgcccccgacttcatgaaggatttcatggagggtgcggacaggaacaagaacgtcgagtactgcaggaagaacgagtactgcaggagcaagaggaaccccgacgccccccgttacagggaaggcggggaggattatgggaagactcctgcggactatgggtcaaacggcccccagcccatcataataactcctgcgcccaagaaggatgcggacaaggaagaggacaaggaaggtcagtgagatggcggagatgctgtctctggaggacggggtcctcgccgtgaggtcggcccgcgccatcgccgaggccgagaccgaggacaggatatgcgacgtggacttcccggagacgttccggtgcgaccgcggcgtgttcgtcactatatcggaatacccttccgggatactgaggggctgcatagggtatccgcagcccataatgcagctgtcccagtcgcttcccctggcggcaaggggggcatgcaacgacccccgcttcccgaggctgcgtcccgaccaggccaagaggtgcacgttcgaggtgacggtcctcacggaaccggaaccgataaggtacaagtcgtccgaggacctgaagtcccagatcgagatagggaaggacggcctcatcatgcgttacagacgctatggggccgtctatctcccccaggtcccggtggagcaggagtggaacgccgacgagtatctgggcaacctgtgcatgaaggcaggtatgcaggaggacagctggaagtccggtgccttggatttcgagaagttccagggtgaggttttctccgaggtgtcccccggcggagaggtagtcaggaaatgacccgtgtcgatccggagaccgtcctgtgcgggcgcatgttcgtcgacggggagctccgctataccgaggtcggcatagccgacgggaagatcgtctccgtaggtaggctggtctccggaggggaggagaggatagacctcggaaccagcatgaccgtcctcccgggtttcatggacccccacgtccatctccgcgatcccgggatgacgtccaaggaggatttctcgaccgggaccatgtccgccgtatgcggcggagtgacctgtgtcctggacatgcccaacacgaaacccccggtgacggacctgcaaaccctaatggataagaaacgtaccgtcagagggaggtcgtatgccgactacggactgttcgccgcactcaccccgaactgtcccgccgctctgctcgctccacatgtgccagcattcaagttgttcatgggttccaccaccgggaacatactcctgaacgacgacgaggagatcgcccctgtcatggaggaaatcgccgggaccggaaaagtggtgagcgtccatgcggaggatgatgatctcatagtgcacggggaggaggagaggtgctgtcaggaccacctccgcaaccgtcccgtagaggccgagttctccgccctcaggcgtctggcacaatacaaggacaccaacaggatcaacatatgccactgtaccaatgcggagcaggtcaggacggcatcctccctgggtttcaccaccgaggtcaccatgcatcatctgatgttcgatgccctgaggaacacttccgccatctacaagaccaaccccccgataagggacaaggccaccaaggacgcactgttccagtgtctccttcgcggggagatcacgatgttcgggacggaccacgccccgcataccttggaggagaaatccagggatttcgattccgcccccggagggatccccggcgtggagacgaccatgccgatggtcatggagatggtcagggcaggtaccctgggtatgtgccaggcggtgaggatgggtgcggagaaccctggttccgtcttctccgtccccaaaggcaggatcgccgtcgggtacgatgcggacttctccatattcgacatgaggaaggtgtccgagatcgaccagaagaggctgcattccaaggccgggttcagtccgtaccacggtatgagggcggtcttccccgataccgttataataagagggcaggtacaggtcaaagaaggagagctctgcggcgagcccctggggaaggatgtctgtggctgattacgaagtcgattactcggaagttgctggaaagaaggccgaatgcattgacgggtgcggtatgtgctgtctgtgccagcctgaggtccttcctcaggagagacagttcttcaggaagaaccatccggaatgcctcgtgaggagccgcggaccggaccagtatttcgctctggcactcaagaaggggagggggtcctgcgtcttcctgaacgaatgcaggcgctgtcagatctacgaccacaggaccacgtactgcaagcagttcccctaccacctctacgtatcggaccacgtcaaggtggagctcgacatgtcgtgccgcggactctggaccggcaaaggtgtcgacgccctctccgaggcgaagcagatggtggccgccgccgacgaccgcctcaagcaggccgtgaaggaggcatctgcggtataccgcgagttctacgagaacgcccgtgccgccggggtcatggctgactcgtccatgctccggatgacggtgtccgaacatctgagcgacttcaccgacctcgggttcatcagcaagatcctcagcatggccgaggtggaggcacaggtttccatctcgggggccaagaggggggagaagtacgacctgaaggacctcaacgatgcggcgagggagaccgccttggaatccctttccaccgacgatcctctcagcatgcccgtctacagcgcagaggacctgtcctggaacgtcttcaccgtggacaagaacaaagtcgagtggatgacggtcggggacgacggggagttccatcacaaaggtttcgccgacgccgacgagatcgagatcaagcccctcaacgacgagggaagcaaggtcctcgccgagtatctgggtatattgaacggcagggacagtttcctgggttccgtgtactatctcatagatgcgaacgggtatgaggacgacctttccaacgcatattacgggagtcttgccaccgcggtcctcgacataatgtggagggcggccctgcttgacaggttcttcgggaccggtttcggggccagagggataaaggaggccatcatcttctacgatatggaccgtctcgacgcccccgccatcggggcattcgtctgaccaatccccctttccctatactatataataagaatggagacaacaaccttaaaatactgactctagtatgggttggtcaaaggtggctatcctgatagtaaaacccctcgacatcctgaaacaggcgatcggcaagaacgtcatcgtcgtgctgaaaggtaaaagggagtacaggggtgtacttgacggctacgatccccacatgaatctggttctgaagaacgccgaggagctggtttccggggaaagcgtcgggagaacggccacgatcattgtccgcggagacaatgtcatctacatatcaccataaggagaaattaaaatgggagcaggaacagcagcacagggaaggcacaacaagttcaagacgcacattccctgccgcaggtgcggaaagcgctcgtacaacgtcaggaagggagtttgcgcttcctgcggatacggcaagaccgcaaggataaggtcctatacctgggctaaacttcgcgagtaaatctaaaaacgtgaaacaatgtcgggtcttcggcactactgcggtgtaatcggtatcaatgccgaccataacgtagttccatcgttgcagaagaccctgatgatcattcagaaccgcggacaggacagcgccggcatctcggttttcgacgggatggagatccacaccgtcaaaggtgccgggcttgtccagacggctcttccgaaggagagcctagagccctacaagggcaaggtcggaatcggtcatgtaaggtatgccactaccggaggtaagggcgtcaagaacgcccagcctatgaccatgataaccggttccggtatgatggccatcgcccacaacggcgacctgaccacctacgacaaggtcaagaagaaatacctcgagacgggggccgtcttccagaccgattcggatacggaacttataatcaacatcctcaacaagtacctcggtcagaacagcgacatcatcctctccataagggccaccatgggagagatagacggcgcatatgcactggcacttatggtcaacggcaggcttttcgggatcagggacccccacgggatacgccccctcataatcgggaagatcgccggaggttacatgatcgcatccgagagcgccgccatcgacgccttgggcggggagatcgtcagggatgtcgcacccggcgagatcgtcgagatctgtcaggattccttcagatcatatatgccgaaggtgaagtgccactgtgcccattgcatgttcgagtgggtgtacttcgccaggcccgacaccataatggacggccgcgaggtgtacgatgtccggaggaggatcggcgagatcctggccagggaacatcctgccgacgtcgacatcgtgatgcccatccccgattccggaagggcccacgccatcggattctccaacgagacgggcataccctacgaagaagggttcatgaagaacaggttcgccgagaggaccttcatcctgccggaccaaaaggagagggagagggccgtctccatgaaaatgaaccccatcaagagcaccgtcgcaggcaagaggattctcatcgtggacgattccatagtcaggggtaccaccctcaagcagctcgtcggcatgctcaggaaggccggggccaccgaggtccatgtaaggatcggttgtccgcccatcatcgccccctgctactacggggtggatatgaagactagggaccagttcatcgccaacaagcacacggtggacgagatctgccacatcatcggggccgacagtctcgggtacataagtatcgacggactcgtagaggccatcggcaaatccaaggaagacctgtgcctggcatgcgtcaacgggaagtatcccacacgcatcgagggagaggaagagaggttccagagcaagatcaccgacggtaagttcgagtgatccagccgggccattgataacttttaagtaccataactgaatcaagggattatccgctgggcaggtagatcagttggaagatcgctacattggcattgtagaggtcgcgagttcgaatctcgccctgtccactcatcttttgtcatcttatcatccgtctgtgtatctcgtttcgctttgtcgaaatcgtcgttcccggacggcatatcgatgcgataacaatccatccaagtaccattctctgtagaacccttcccctgctggaaactgtgaatacattagtatcgcacggcgatgtatgtccatgaggtataggataggcgaattctccaaactcggaaaggtctccgtgaagaccctccgctactatgacgaggaagggatactgaggcctggctatgtggacggtttcaaccgttacagatactatctgccggagcagctcacgaccctctgcaccatactcagataccgcagggcgggactctccatcgaggagatcaagacgctcctttccggggcggaccccctgccgatactgcgcgggcgcagagcggagacagaatcggagaaggattccgcggagagaaggatggcccttctggacctcatgatcgaaggagacgaccacatggattatgagatagaggtcaagacgatcccggggttcattgcggcctacagggaaggaatgatagacaattattcggacatggccgggttcgtcatggggttcgcggagatgtgccggaggtccaacccggatgtcgagtgcacggaagacgactactgcttcgtgacatatgcggatccggagtacagggagagggacatctcgctccgctactaccagtccgtgaagaaggccgggacacctgccggggagatcggattcaaggagttcggcccggtgacggcggcctgtgtcaagcatcgggggccgtacgacggcctgggcgaggcatatgcggccataatgagatggatgtcggagaacgggatggagctcgtagaacctccgagggaatgctatatggacggatgctggaacaaggggtccgaggacgaatacctgacggagatccagttccccatcgggaaggcgtgatccgctcattctccggttccgtgcctttccaggcattcggagacggtcttcaggggtatgtccatcctggaggccgtctcttccgccgtcatgccgttcctgatgaaacggagtatgacggaatccaattcctccccgacctcgatcatatgtccgtcggggtcgtataacctgaccgcgcgctgcccccatgtgtgttccacaggtctgtggacgtacttcacatccatatgttccagacgtccgcagaatgcgtcgaagtcgctttcttcgaagtacagttccccggcgttgtccggcagggatatgtccgtttttccgatgaacgtcttccaggtgtccattgtctgcaggaagatccctccttctagggtgacgttggccccgaagtccgatacggtctccaatcccagcacatccttgtagaatctcctgctcctttccatgtcctttaccgcgacgagggtgccgacgaatctcatgttatcaatatgtgtcagagggtgcggggtattgaaaagtatgggcggacgcgccccgccgcgtgtccggcccggtatgtcccagactcctcagtccggcagatcgaccgccgcgtcggcgagcatcatgcggttctccctgtacatggatacgacgttggcggtacgtacgactatctccttctcggattcgtcgagaccctccatgtccgggacgcccccgtccttgcgggatccgaggactgccccgaccttggcccggcatgcctcccccgcctccgacagggaattggacaggagggagcactcggcggtcagggcgttctggctgctgatgaacttcccgaacgggcggtccggttcgcgtccgtcgttgacctgcatcttcgacgctatggcccctgcggtcatgacaaggtacgtgtcgtccgtctggcacttcccggtctcggccaattccctcaggccgtccatctgtctggaggataccttgagataccttcttccgagctccacggactcgtcgcggaggcggtacggcaggatggtcatgttggcgagggtggccgccaggactcctccgaggatgtagagtatgcgttccaccactatgtctccggccggatccgcggccgatgcggccagcagggccgtcagagtgatgaaccccatcatgaggtcgtacctcttggggtctaccagggtgtagatgtagctgacgaccatcaggaccaacgccaatatcccggggtctcctccgcaggccaggactatgacgccgaatatggcggtcccgaccagggtgcctgccacacgcatcccggatttcatccatgtgccctcgacgtacggttggacgatggccgcggtggtgtacaggagccacttggcgttctccagctcccagtactgccatacgaagacccagagggtgaacatgaacgacatgcggacggcgaacgtgaacctcacggaatcgcgtctgaagttctccttgaacagggtggagagcttgggggcggcgggtgctcccgcgggggatgccgttcccggcgtctcggaggagatggccttcagctcggaccctatggcgcggacggaggatatgatgccgaaatccgcacccttgttggcggagaggaagccctctatcgatgcgagcacgtcttccagggatgtctcgtcgtcctcgtggcggcggagatccgtcatcagggaacgtatgccggagagcacctccggatccctctccctctcgaacaccgtgcgcccgaggttcatcagggaagccatcaggtccacgatatggctgtccctgtggctggcgaagacgcggtccctcagacggtcgtataccttggagttcaggtcggagcacaggcgttccaggttcccggaggacacctcctccccggccaagaccttctcggtcccctcctctatcgccttgcacatggatacgaccgcgttgtggctggtccgtttcatgctgttgcggttcaggaggacgttgagtacgaccgtcgctatggagccgactacaagtgccagtatgcgcatgggcagttcctcggcggtcacggggaccgacagcatgaacgcgtatccgagtatgaacgggaagtgcaggggggagttgaggtcgtggaccgtcaggaacaccgtggtgaagaccacggctatgttgacgaataccccgaggaagggatcgatcagtgccagatacgatcccacgcccagcatgcatgtgaacagtatcagggtcccggtgttccaaagcgggcttaccgacaggtccctctggagcatcatgagggctatgacgactatggccacccccaccagggagttgacctggccgaacaccttcgagatgatcccgacgaccacgcatatggcgaggaagaacagggtcctgctcgccactcttttcatatccatagcgggaagtttacgggacccgatattttaaccctatgtccgaacaggccgaaacgtcatatttttatattaacttcaaccgaatatggtctcaatccgccgtctttggagggtgatgttaacctgttccgaaagaaggtgccttattataaaggcggagcggcccgtcccgtctccgacggcggttttacgctggacgatatcgggttctccggacccgtgcaaataaatatctatccgcctgggataatgcagggtactgatcccatgtcgaaggacgtaacgaatctgacactcctgtgcgactactacgaatacacgatggccaacggctacgtggaggcgggtctgtcggaccgcatcgtatacttcgacatgttcttccgcaacgtgccggacaacggcggcttcgccataatggccggtctggagcagatcgtcgagcgcatagagaacatgcgtttcgacgagtcggacatagagttcttccgttccaaagggaccttcggggagaagttcctggactatctgcgcggattcagattcacgggggacgtctacgccgtccccgaaggcactccgatattcccgggggagccgatcgtcaccgtgagggccccggccgcccaggcgcagatgctggagaccttgttgctcctcaccctgaaccatcagtgtctgatcgccaccaaggcgaaccgtatcgtgcgcgccgccgatggcaggggggtcatggagttcggttcccggagggcgcagggaagcgaggcggcgatcctgggggcgagggccgcatacatcggaggatgtgtcgggaccgcatgcacgatctccgacaaggtctacggcatccccgccagcgggaccatggcccactcgtgggtgcagatgttcgacaccgagtacgacgcgttcgtggagtactgcaggctctatcccaccaacgcggtcctcctggtggacacctacaacgccctggagagcggggtccccaacgccatcagggccttcaaggacacggggataacgaagggagggatccgtctcgactccggggacctggcgttcctcaccaggaaggccagggagatgctggacgccgccggtctgaaggacatcaggatcgtggcgtccaactcccttgacgaattcatcatccgcgacctcatcgaccagggagcatgcatcgacgcgttcggtgtgggggaccgtctgatcacatcccacagcagccccgtattcggaggggtgtacaaattggcggccgtcgaggacggggaggggaggataatccccaagatcaagatctccaacaacacggccaagatcaccaccccgggattcaagaaggtctacagactcttcgacagggacgggaaggccatcgccgaccagatctgtctggcggacgagaccgtagatccctccgtgcctttgaccctcttcgacccgcaggcgccttggaagaagaagacggtgtccggattcatcgccaaggagctgcaggtgcaggtcttcaagggcggcaggagggtgtatgacagtccatccctgccggagataaggagatactgcgaggagcagatcggcaccctgtgggacgaggtcaagaggttcgtcaatccccaggagtactacgtggacctgtcccagaggctctggcagctgaaacaggacatgctcaacaacagggccggtccgggtgactgatcccgggtccccgtcccagggagaacgatccctggtcgaatattttttcagggcagccttcctgacagcggcagcatgccgtaccgaggcatctccctgtatcgatgcggaacatcccgtcctcgaaggccaaggcatcctccggacaggagcgtacgcaggtcatgcatccggagcattcccacgacgcatgcatcgacgtcccgcagtcggccacggtcatgccctcgcctacatcgtctatgtcgcggacgaccctcctttcgaccgtcggtccggaaggcggcccggaagggagtacgatccctaggtcctcgaccgccttggaataacgccgttccgacatcccttccgtccaatgtgccagttcgcagacgtacaggctgcggaacatgtcgtcctccgcgaacatgatgtgcttggtcaggagtcttccgcggaggtcgttgagaggctttatcatgtcggggtccaaggcgaggtccttggccaaggccagagaggtgttgcccacctgtaccagtctcccggccccggccgggactatgccgacggcctgagccttgacggggtccacgtacgttccggatgcgcctgccatgtacatgacggatacgtctccgccgtctattccggcggctgcgatcagggacatatgcccggcacggatggcccctatggccttacccgcttccttcaggtcctcctccccgaagcgtatcctgcgggacacctctatcggacctccgcgtatctccgggggttctatgcgcccatcctgcatccccgcatagaccagggcgacgaccccggtgccggtgatgcccgtcgggaccatgccctcggccctggagattccgctgcggaggttcaggaggggcccgtcccgggccacgaggtcgcggtccaggaccttcgccctccatcccctcggtgtacgtaccaggtcgcagagggccccgggtcccgccagcatgccggacgatatctgctgtccttcgagggcgggtcccgcggccgcggatccggaatatatgtcgtcccccaccttgagggccatctccgcgttcgtcccgtagtcggtgaccatgcacatgtcgtcgtccaggaagcccgatttcagcatcatggcgagcgcatccgcccctatctcgtgccttacggcaggggggatgacgacctcgatgtcatgtgccagacctatcgtgtcgcccgggactatgcgtccgctgcggtcgacctcccccacgttctgggacgacagcatgttcttcccagcgtatgccaggtccctgacctccgtcccggagaacagcgacagctgtatcgggttgccgcacacgcctatgcggaccaacctctccggggagaggccggccaccaggccgtgtacggcgtccagcaggatcccgcgtgccagtcccggtccccgctctatcgcgaaggacaggtggtccatgacgttcgatcccgggaccgggttacgggtggtgacatacgtcctcacgaccttcccggatccgaggtccaggagctgtccgcgtatgccgctcgtcccgatatcgatggctatggcctgttccctgcacatgttccagacgtccgattcacttcctgcggaagtccgtccacctcttgtcctcggagcatattccggtggccacgtgcaccgtctccaacggggtcttggtgtatacggcgttgccgaaggtgtccacgaacgccttggacacggccgcaccgccgcatgccaccgatacccccgtcttctcagtctccagcattccggcggtgtcgaccagccccttcttggtcgtactcatcagggtcgacccgcagacgagttggatgccgttctctctgacggcctccaggaccttggacgcaggtacgtccctcccgaggtccacgacgttatatccgttggcgcgcatgatggcggcacagatgttcttgcctatgtcgtggaggtccccctcggcgacgaacgacgccacattccccttgctggggacatccccctgcttcatctggcacatcttgatgcccgcctgcatggcgtcgttggacatcagtatctccggcacgaacgccttgcccaggtcgtacatctcgcattggacctgtatccccggcatgagggcgtgggtgactacgtccacggggtccttcccggaatccaggagcttccggacggccgtctccacgtccttcctcttcccgtccagcaccccctgggacgcggcggcatacgacgggtcctccgggaagtactcgttcttcagcttctccgcatccaccctgttccgggaatcctccagtcccagatatccgagttctatcgcctctccttcggctatcagcttcctgtagagcaccggatcctccatgcgcatcctcaggacctgttccatgaccagatccatatgcatcagaacacacctccttcttcccctgcggcctcggccaccttgccggacctcagcatcttggccctcgccgcaccgatggcgcggacgcagtcctccacttcgttcggatcgggtatgggggtctccctgcatgccctgacatacgccttgaggttctccagcggggtgccgttggagacgtcgcatgcagtacctaccacatccaccccctccctgatgcactccgctgtcctggcatacacctgctcgggggtcccgttgggcatgaggtcgatgacgtccagactgcccaggcactgcatcctgttccccagttcggccctgaccagccatgccggcggggcgtcgaaggagaagcagtccatgccgctctcccttatgtgcttcagaagcttctccgtgtgtccgcacatgtgcagtatcttgggggcgctgacggcccttgcgaacttcctgtggtaggggaggacgaactccttgtacgtctcgggggagatcaggtcccccgatgccgacggatcggcggggaacaggatgtgcgcccctgccgccacctgctgtcttccgtattctatgcagaaatcggtggccgcatcgatggcctcgtgggccttctccgggtcggtgaccgtcatcatcaccagcttctcgacgcccattatgtgcccggccacggtgaacggggccgttatcaccggtatgattggaaggtcgccgcagtacctctcgcggaggatctttatcgcgtccaagacgaccgccgcccttcccttcttgtagaatccaccgtcccacgagatgtccttcggatccttgtaggcgggaccggtcaccgggggtctgtccggcttgttccaatccaacctgcatccgagcacctccgcctccagcgatatgtcgaactgcggtctggccgcctctatgccgcacacttcgtacggtgccgccgccaggtcggccatcatgaccgggtccctgtgggccttgggccatgtggccccacagaactccatgaggtccttggttgtctgggccaacgggttggccggcggtacgtagtcggtccttcctccgagaacggcggcgagtgcgcgtctcgtaggtgtcatttcctgagtcatcttctacctccgtcctgtcatcatcgtcgggatgtcgacagttgatttgacatcggttttatctgtcctaaaacctactacgaacatggagggcctgtggggattcggtctcccatggtctgtccgattggatgttgttattggatttttctatccattagtataaaaataaaacctatatgggacacatcattaatatataggtggatttaattttgaacatgttcgcacttacaactattacagtcgtcaatattggtaagacaaaacttcaaggctgttaatcggaagatccctcatgactgcagacgagagtaagcgcatcgcacgttatggctgggccgcatttgcaatattggcactggcatatttcatggtatacctgcaccgcaccaccggcggagcactgtcggatacgttcgaggattattacggggtgggtaccacatccgtggccctcctggcctcctcctatctttatgcgtataccctgatgcagatacccagcgggataataacggaccgtttcggtcccaggaaggcggcgtcggtcttcatcgcactcatagcgctcggttccgtcctcagtgcggtctccgcatatgtggacaacttctccctgatggtcctcggcaagttcgtcatagggttgggcgccgcggtggtgttcatacccatggtgaaagtgctggcactttggttcaagagggaccagttcgccaccatgaacggggtgatcctcctcatcgggaacatcggggccatagcggccgcgacccccatggtcctcatggtggacctgttcggcatcggggacacctacatgatcctggcggtcatcaccgtggcggtcgcctgtctgtgctggctcttcgtccgcgaccgtccggccgaaagaggtcttcccgaggtcgaccacgaggccgagaagaaggtcggtacgatggaggccctcaggacgatcttcggaggcaggatgaggttctggcctctggcactcagcatgttcttcttcttcgggaccatgatgatgtggcaggcgtcgcaggccgggtcgttctacatatcggtatacggctacgacctccacagttccagtataatggtcaccctgatcggggtgggtacgatagtcggatgtcccataggcggtctgctgtccgataaggtcataaggtccaggaagaccgtgtgcctgatcggcaccggggggtatgcattggcctgggcggtcatgtgggcgacggtcggtcaggatgtggcatcaggcatgctcttccagggggtgctcaacttcctgttcggtttcttctcgggattcctggtatccaccgtggcacaggtgaaggaggcgttcccggcgtccatgtccggtctatccgtcgcctccctccacacgttcacgttcatagggggagcgttggccgtggccacctgcgggttcgtggtcgcggagaggacggtggggcagtaccagacgctgtgcctcattgcattggtcatggcgatactggccttcctgtgcgaggtggtgtcggtggaggtgacccccgaggacgaggcgttcaccgacccggccctggatttcctggagtatctgaccgacaagtcggagtgatcccggggtttccgccgatccggaatcgtataaatggagacgatcggtcctagatcagcaccattcacgacatgtcatgtccgtccaaaagcattcccgagagcaccatggatccatgtatccgacggtctgggtattatgcaccgtgcatgatgtttgtttatagatgccgagtttcgcatcattgtttcagatgcattacggcctctgtcgggcatcgatcttgaaagtttctttgctaaactgaaatatatggccgacggtcatggaattccaacggaaggatgatatggccgataaagggaactacgactggacggaattctacaaacattttgccgacgggcttctgcatttcaagaacaacagagaagaccttgtagagaaaatagtccgttcctatgatgaggcgggcatcaaccttccaagactgaccgcggatggcaaaacccctaaggatatcgatccgttctccgtgatggccttattcaacagggcgaatactccgcaggttaggaaaaagatcatccacgccctgtcaggagccttcggaacgaatgtcgacgaaccgacgtcttttgacggtatcccggttctcaactcgataaacgctttgttctacgatatcgaaaagcatacgcaggaagacctggatactttgtgggagttgttcgaatccgcgatatcatacgagggtacgggttctatcgacgaccgtaggagattgatcgaattctatgataaggcggtcaatcagagaaaagtcaaatggaatttgaccatggggctgttttggatccgccccaacaggtacataagtctggacggtcgtaacagatggttcttcgaaacgaagaagatcgttccgtcgaagttcggaaccgcgatcggcggggaggactatctgagattctgcgatctgcttcttgacggcatcaggaccggagggatggagtacggctcccttcccgatatctcatatgatgcatacatcacatccgagaccgttaacgagcagatccgttcggagaaagttgcggagacaggcgttctcggcgatgggggtgtaagggtcacccactattggatctattcccccggttacgggtccttgaaatgggaggaattctacaaagagggcatcatggccatatcaagggaggaactcggggatctgagggaatacggttccagaagcgatatgcgggaggcctttatggaagcgagggatgatgggaggtcgtataagatggcatccttggaaacatggcaattcgtccacgaaatccagctgggggatgtgatcttcgcgaaatacggaacggatgcggtcatcggaaaaggtatcgtggaatcggactacatctatgatccgaaccgttcggacggatatgtcaatatcaggaaggtgcgctggaccaacaatggacttaggccccatcccggaaaagcgataacgaaggtcctcacggatgtcacggcatataccggatatgttgagaaattgaatgcactttatgataaaacggacgactatgaggaagaggagaaggttgtcggatgcgaggagtactccaggagcgattttctgaacgatgtattcatggacgaagagatgtacgacgatctggtggatcgtctgaggatgaagaagaatatcatcctccaaggccctccaggtgttggcaagacctatgccgccaagagattggcatgctcattcatgggtgaaatagaccctaatcgcatcatgacagtccaattccatcaaagctatgggtacgaggacttcatcatggggtatcgtccgacatccgaaggttatgagatcaaggacgggccgttctattcattctgtaaaaaggcggaagcggatgaggacaatgattatttcttcatcatagacgagatcaacaggggaaacataagcaagatcttcggggagttgttcatgctcatcgaatcggataaacgcaaggtatccatccgcctgatgtacaaggatgagttgttctccatacccaagaacctgtatatcatcggcacgatgaataccgcggatcggagtctggcgatgatagattatgccctccgtcgcagattttcgttcttcaccttggagccggcattgacccagcagggatttatcgaatattgtgagtcgaagaaaagcaaagaactgaacaagcttgtcgagacggtccgtagtctgaatgcggccatcgaatcggacccttctcttggcagagggtattgtatcgggcatagctatctgatggtcagcggacccgtggaccagaagacgctcaggtcgatggtcgtacatgatctcatcccgcttctcgaggagtattggttcgacgagccgaccaagatcagggaatgggaagatagattgttaaggtcggtcgaatgatccctgtcctgaacatctattacatgctgtcttacgcctatcaaacactcagaacagggaaatatgcagaattggcgaccatgaggtttgaaaccgaaattctgcgcgtgtaagtaactcaacccttgggagttgcgagacatctcagatcgcatacctcgatgcccaagacgggttcattgggtacttccactccgaacattccgaagatgttcctgcagttcttggatatctccgaaagagcggacgaagaaccgtaactcagacagttgatcgtgttcaggtaccccagagtctgaccgacggacatctcccgtttgccggattcccttatctcagcgcacagttcgcatttgaggatcagtgaaacgaactttatcagcgaacgtccgatcatcgtgtatttgtcgggagtacggtgcctcctgtcgtccgatttgctgaaatcgaacgcctgttcggtaagtctccttgcgtcatatgccgtcataaccgtcgaccagtccagatccgatgaggataacatgacgaacactcccgcgcggttctcagcgaagcttacggaattctgcttctccttgacgatcaccttcttcccgtcggcctgtacatcgaagtgtttgatcgccttcccagcgatcttcttgaacctggccacaggatccttgcattctatctctgcggccttcctcttcagatcgttgagcatcatcttgtggttctggacctcgtcggagtacttcttggaatcgaaacatacgtatgcgttgatcataccatcatccccgtgtccggcatcgccggacaccgtgaaggagtatgcctgcgatccgtccgcggatagcctgtcggcttccgtcagaccgatctgcgtcttccacaccttatatgcatgtccgtcgtgaatcatatccagagattcgttggtcttcacgaacctggacatcagcgttttgatcgctttggaggatgtgttcgcaggggcggtgaatcttatccccttgtccaggaggtgtttcacattggcacccgaaacgaatcccctgtcgaatacgaacaaagcatccttcttcccgtatctttctatgtcggacaccatcctgtccacggtagctatatcggagatcgtaccgggataatggcggaacatgagggggatgcctctcatgtctgtggcgaaaccggtcttcgtctgcttgatatcctctccgtccttgttgttcaccacatattcggccatctggtccagttccgaataagtgccgttggtggtcgtatcccaggccaccagcccattggatcccttaaccctgagttcgaagaaacggtcgatgttcatcgccttctccccgagattcctggtgaagtccgaaagcgttcccgaatccatcgatgctctgagatcatagaattcgcggatgtacgtcctctccaaagtggaatctatgttcctgaatgcgcccggttccataagataggccatcgcagccgcgagaatggtcttccccgaattgccgaatgccctcatgaggtcctcgccgagggacatcctcagctgcacttcgtgcagcaggtatgtcgccccgtactcctttgacgacacacctttgagaatcgcgatctccttctctttcgcgatttttctgcggttctctgcagatttttcgggaatcttgggaagcagctccttggtgtcgggatccaccctgcccaagtaggtggaaacggtctttttcttaccgttttccatagtagaggttacctcataagcatagaatctgtcccctcttttgacgatcgtgcgtttgattccgtctccatccctcggtctgaccatgttattacctaacataaactgtatgtaagtaatggtatataacacctcttaccgtaccctagccagcatatgaaaaattgatcagaaaacaggattgcgattacttagcacgcgcagaatttgggtttgaaaatacggcggatctgatgtcggccattctgataaggacgctcaatacacagttgaggcgtggaattcggaggggctatgtaaacaagtcggcggagatgcccaccgtacgcgggaagatatgtatgtcggagtctgtccgtaggatgtcgtcgacacgtcacaacgtcgtctgcgactacgatgaattctccgtcgacatctatcccaacagggtattgaaagccactttgaacctgctccttcactctgtaataccgaatgagaggatgatggagatcagacgcgccctcgccgtcctttgcgatgtcggaacggtggacgtcaggcatgtcgactgggatttcagatccgaccgcagcggtgatgattatcctatgatgatgtccctgtgtgagctgacggtcaagggtctgcttcaatcggaatccaaaggcgacatgaaggtcaggaccgtgttcgacgaacagcgcatgtgtcgtctgtatgagaaattcatcttggagttctataggagggaacatccggaggtcgtcgccgaagcctcgatggtcaaatgggccttggacgaaggtctcccggacgatcttccggtcatgcagacggatatcacgctgagatgtagcaatcgtgttctgatcatcgatgcgaaatactacgagaacaacatgcagtatagattcgacaggccgaagatacattcccataacctgtatcagatcttcacttatgtgacaaacgaatccgcatacggaggggatgtatcgggaatgatcctgtatgccaggacggattgtgaaaagcaacctgattcctccttcgtgatcaatgggaacaggataaccgtcaggacattggatctctactgtgatttcgatgagatcagaagacaattggacggtatcgtatgtgatttcatcaaatccggcagcccatgaatacggttttgcaggatttttgttcgacagcccgaggtttttcctctggttggagttttatgttgatgatttataaaagtatttatagaagggcaattactatacgagcatcaacaatccgtgggatgactgataaatggcaaaaagacagttcaaaacggaatcgaagcgcattctggacatgatggtcaactccatctacacccacaaggagatcttcctcagggagctcatctccaacgcatccgatgccatagacaagctcaactacaaggttttgacggaatccgacagcaaggtcggaaaggacgacttccgcatcgatgtcaagatcgacagggatgccaagacggtcaccgtatccgacaacggtatcgggatgaccgccgacgagatggagaagaacctcggatacatcgcccactccgggactctcgagttcaagaaggagatcgacgacaaggagaacgaatccatcggacagttcggtgtcggattctacagcgccttcatggtggccgacgacgtcaaggtcgtctccaaggcatacggttccgaggaggccaacatctgggagagcgacggtgtcgacggatataccatcaaagagtgccagaaggacggtttcggtaccgacatcatcctccatatcaaagacgaccagggcagcgaggagtacagcgagttcctggagacggagaggctcagggaactcgtcgagaaatactcagactacatccgctggcccatccacatgaccgtggacgagagcgagtggaaggagaccggcgagaaggacgagaagggcgaacccaagaaggactacgtcaccaccaaggtcgacaaggtcgtcaacagcatggtccccatctggaagaaatccaagaaggaggccgacgacgacaagtgcaaggagttctacaaggacaaattccacgactatgaggaccccgtctccgtgatcagggtgtccgccgagggtgcggtgacctacaaggccctgctgttcatcccgtccaaggccccctacgacttctacacccgcgacttccagcccgggctgcagctgtactccaacggggtcctgatcatggacaagtgtgcggacctgctcccgtactgcttccgcttcgtcagaggcgtcgtcgactcgcccgacttctccctcaacatctcgagggaggtgctgcagcacgactcgcagctgaaggccgtcggtacgaacctgaccaagcaggtcaagaaggagctagagaagctcatgaaggacgatgccgagaagtatgccggattctacgagagcttcggcaggcagctgaaatacggcgtcgtcgaccagtacggaaaggatgcggacctcctcaaggacctcatcatgttccattcggtcaaacaggacaagcagatctccctggcacagtacgtcaaggacatgcccgaggaccagaagaagatctactacgtgactgcggagaccgccgcccatgcgaaggacctgccccaggtagagcccgtcctggccaagggatacgatgtcctcgccttcaccgacgacatcgacaccttcgtcaccaacgtcctgagggagtacgacaagaaggagttctgcaacgccaccaccgaggatctgggtctcgagaccgaggaggagaagaaggaggcggagaagaaggacgaggagtacaaggaactcatcgccttcgccaaggagtccctcggagaggaggtcgccgacgtgaagatctcccacaagctgaagaaccacgccgtcctgctgaccactcagggcaacataaccttcgaggtcgagagatacttcaaggagatgcccggtcaggccggcaccggtgtgaaggccgcaagggtcctcgagctcaactccgattcggacgtgttcaagtccttggatgcggcctttaaggacgacaaggagagggccaagaagatcgtcaaggtcatgtacggacaggcctgcctcatggcgggacagcccatcgacaaccctgtcgagtattccgacctggtcctcagcatgctctgaaccggacgtccgggtccggggtttatgccccggacatcggccccgccggaccttttgtctcctgtccggcgggatgtccgcatattcccgacatcgttatttttttgagtccaatgtctaggatctagacatctgggtcatgatcggatataggtctccgtcccggaaaaatcatcgttgcgaccgctttgggaagaggtttccggcctaggggccgtaagaggtttcgtatccatctgcaccgttcactcggcgctcacagcatccgcgccggactgtccggtcctgatcctgaaggcgttttcgacatcataggtgaagatcttcccgtcgccgacagcaccggtatggatggctctcttggccgcttcgaccacatcctgtaccggtatcttgctcgcgacgatctccgccttcatcttggggagaagggcgctgtcgacgtgcacccctctgtacgtctgggtatgtcccttctgggcaccgaatccctcgacgtagcttatcgtcatcccggatatcccgagaccgtccatctgggacttcagggctccgagcatctcgcggcgggtgattatgacgaccttcttcagggtgccggcggcggccttcctggcgataggtgcgtcggccatagccgacggattcctgctgcagatgagaaagccatgtgcctggcacatcaatctggcggtcatggcggtcattgccgtgaccggactgacggtatacgccgtcgagggttctcagacgtgtctcgtgatagcggtcctgatggccatgacgatcgtctcgtggatgatgggcataaccaaggggtatttcgcgacgcagaccgccgaatgaatgggaaaagacccgcaggccgtcaaggcctgcggtaaatgtaggtttactggaagttcttgagctcttcctggtattcgtcgtactccttctgcacgtccgcctccgcatatccggtgagcttgctcacgacgacgatggcgatgaacgacaggatgaatccgggtaccagttcgtagagtccggtgtcgaacaggcaccagtcccctccggcgattattccgtcgctgatgaggaacgtgttccagaggatgatggtgacgaatccgacgatcattccggccagggcacccttggtgttgaccttcttccagaacagtgccaggatcatcaagggtccgaatgcggctccgaatcctgcccatgcgtaggagacgaggtccatgatggccccgtcgctgtcgagggcgaggaacgccgcgatgaccgcgatcaggatgacgacccctctcgccatccacatgagacgtccgtcgggggcctccttcttggcgaatatgcggtacaggtcgttggatacggccgaggacgccaccaggagctgggagtccgcggtggacatgacggccgccatgatcgccgcatacattacggcggcgatggccgccgggaacagggacttggacagttcgacgaacacgttctccgcattcggcagtcccgcatccccgaagtacgcccttcctacgagtccgacgatgcaggtgaacgcgaggcagatgacgatccagagggtggctacgcgcctggatatcttgaggtccttggggttcttgatggccgtgtatctcacgacgatgtggggcattccgaagtatccgagaccccatgcgagggcggatatgatcgcgatgacacccatggccgttccgttggaatacatgatgttctcgaagtgctccggcacggtcgacatgttgtggaggatgtcgatagtattgtcccatcctccgagcgcgttgatggccgccaggggtacgaggacgagtgcgaagaccatcaggataccttggatgaggtcggtccagcagacggctttgaaccctccgaggaaggtgtaggcgatgacgatcaccgcaccgaggatcatggccgggacgtagtcgatgtcggggatgatcatcctgaagacgttccctgcgctgacgaatcccgatgcgacatatacggtgaagaacacgaggatgatgatcgcacttacagtgcggagctggttcctgttgtcatggaaacggttctcgaagaattcggagagtgtaagggagttcttggccttctcggagtagatcctgagccttttggcgatgaacagccatgcgaaatacgatccgatggccagtccgataccgatccatatctttcccattccgcacaggaagatggatccgggcaaccccatcagcagccatccgctcatgtccgacgcctgtgcggacatggcggtgacgtacgggttcagtgtgcgtcctccgaggatatagtccgacaggttctcggacctatgataatagtagtagccgatgccgatcacgactgcgaaatacaggatgacaacggcgatggtgattacttcgtcgctcatgcgatttgctccaaacggggcgcataagtgaattaatttattaataatcgttgtacaaaaacagcgtttgtaccgatattccggagagctgtccagacggtcagattaagtggatggatgctatatccattgtattaaatacttggactgcgatattgttgtcgaagggcgcggaagcgtctctcctcacttcagactgtgcccgtgcgcaaaggacagacctcctcctccagggtcttttcttgcgcacgggctgtttttatccgtctctctgctcaggacgtcaggatcccgcctatgagttcgtgggcgtctatccaattgaacgttcctacgaagatgtactcgatacccatggcggcgatcaggagtccgatcaccctcgagagtatgcctatcgcatccgtacctacggccttcatgatcctttcggagcagcgcagtatgaaccacgtgactcccagtgcggcgagtccggccacggcgacggtcaggatgtcgtacgagtcggtaaggaggatcgcctgggttatgacgcccgggcccgtaagtatgggtgtggccacgatgacccacggggcgccgctctccgacttcttgctctgactgaggtcgaacacgaggtccaccgccatcaggaggagcattatgcctccggcgacgcggaagctgtccatggttatgccgaagacgtccatgaggtaaggtccggcgaatatgaacaccacgaggagtgccgccgcgaccagggccgctctgtcggcgtacgacctgacggtgtccccgtccagccccttggtgacggacatgaacaccggaagactcgcgaacggatccaatatgaagaagagcgataccgccaccgtcagaagggacgccggatccatggtgtaagggtatggtgtgcgagtatatcattgggtcggcgcacatgtggccctgtgtggatctggcacattcccctcccggaaaaggactgtctaacgtatgtcagtcacgtttatatccgacgaaaatgtatgagcggacatggatgcggatgggatactgcagtctataagcgataatctgccggaggtgcttctggtcgtctccggggtcatggccgtcttgatcgcacttacatacgtcaagaggaaggaatcggtactgtacaagttcctgatggtggtcggggtcgtcctcggcgccgtcatgatctatgaaagcctcaccgtcggcggggaatggcatgagttcacccgtatcgtgatcgcgatagccggtttcgcattggtgataaggccgttccgcaacgtcgatttcgcgataatccttgctataatcgccatggcgatagcatacatctatctgggaagcctcaccggcgacctcgagggactttcccacgggaccgtcaggatagtggtcgcgatcgtggcaggtgccttcgtctacatggtgttcaactatatccagaaaatcgcgatgatggtcgggaagatcctcaactggtggcctttcctgttcgttatgggactcatatgcgtcgtggagggcaccctcatgctgacgggcaacggctccatattggatctataccataagtatgcgggcggggccgaggagatcgtctcctccctgtcgttactcggctgatgcagtccctccgtcgcctttcggcgccggagggtcgcccatcccttttccgatgtacatttttcggcatcttgtccgcagacgtgccgtatggtcccggcgggtgtccggaaccttccagaatagtcgtccgttccgagagccagatcgtcttaccgattttataccggatgaggcttcaaggtctttggaagcctcttcggcgatcgtatgggtttgttgtcaaagccataatctttaaatgatagtagccgatggaggttggcagggcccgtggcttagccaggatatagcgctggccttctaagccagacgcctcgggttcgaaagtcccttaaaaggaccgaaagtcccgacgggcccgccaaagagtccgtctgcgccaaacggcgctcacagaggaagtatcatgaagagaagctcacgcgcctggaagaaacgcggcaaccagcgttggaaatggcgcaagaaaaagatgaggagaagaaagagagcagcaaagatgcgcaagaagtgacgctgacgctctcagcggcacaatactggggatttaggctaacctggcagactagcgggctccagttatgagcgtgatttgatcgagtatgctgaagttatgatgaataactggagcgatgactcatcaatttcatggggaggtagctcctccccgtggtggaaacccgcctatgggggttcaaatccctcagtccccacctaccgcatctttaaagttctactccgccccgaaaggggtaattaaccttttcaccgtgatcgcggtttgttttgcacttgttaatatatgtctagacgattgattaatcatcgaactagtccgtgatttctattaaacgcctatcgggcgttgtgcaattatgtacaataagatccttattgcagtggacgggagcgagagtaacaacatcgcggtcgaccagggattgtgcttggcaaagtctctgaaggcgggatccgtcaccgcgatctgtgtcttcgacgagggcaattacagcaccgtcatcagggacagcagcgccgagtatcgcaagatcatggcggaggagtccgagaacgccttgaagtatgtgaaggcgaaggcggcggagatgggtgtcgccgtggaggccaagaccatgatgggacgtccagccgaggtgataatcgaggaatccgccgactacgacctcgtcatatgtgccaccctgggaaagaccgggttcgcgagagtccttctcgggtcggtcgcagagaacgtggtgcgtcttgcgaagtgtcccgtgctcgtctgccgctgagacgtcaccgccgtcggacatctccgacggcccaatcttattttccaaacggaaaaaaccccgggcccggaggcccggattaagggaggtttcagttcttgaaactgtggacgggggcggggatccttccgccgcggttcacgaagtcggcgcagccgtaagggttgaccggcatgatctttgcattcccgaggagacctccgagctctatggagtcccctgccttcttgccgatgacggggatgaccctgaccgcggtggtcttctggttgaccattccgatggccatctcgtcggctattatgcccgagatggtggatgcaggggtgtcgccggggatggcgatcatgtcgagtccgaccgagcagacgcaggtcatggcctcgagtttctccaaggtcagggcgccgatggacgccgcctccgccatggatgcgtcctcggtgacggggatgaacgctccggagagacctccgacgtacgaggatgccatgatccctcccttcttgacctggtcgttcaggatggcgagggccgcggtggtaccgggggctccgcagtattccatgcccatctcgtggatgatgtccgcgatggagtcgcctacggcgggggtgggtgcgagggagaggtctacgatgccgaacggggtgtccagcctcttggacgcctccttcgcgacgagctgtccgacgcgggtgatcttgaacgcggtcttcttgatggtctcgcagagggtctcgaaactctcccctctgaccttggagacggcggtcctgaccactccgggccctgatacgccgacgttgatgaccttgtcgccctcggtcacaccgtggaaggcccctgccatgaacgggttgtcgtcggtggggttgcagaagacgacgagtttcgcacatccgatggaatcgcggtccttggtggcctgcgcggtctccacgaccttctcccccatgatcttcacggcatccatgtcgataccggtcttggtggatcccagggatatggaggagcagatgtgctcggtcttcgccagggcctgcgggatggagtcgatgaggagcctgtcggaggcggtcatacccttctgtacgagggcggagaaccctccgaggaagttgaccccgatcttctgggaggccctttcgagggccgaggcgacctccacgaagtcctccgggctgtggcaggcgggggctccgacgatggcggcgggtgtgacggacaccctcttgtttatgacggggatgcctatctcgagggcgatctcgtcccccacggagaccaggtccttggcgttctcggtgatcttcgcgtagatgttctcacagaggtcgtcgaggtcgggggtcatgcagtccagaagggagatccccatggtgatggtccttacgtcgaggttctcgctggagaccatctggttggtctctatgacctctctcagatccaccatgatatcagatcctgtgcatcatgttgaagatgtcctcgtgctgtgccttgatggagcagccgaccctcttcgctatgtcgtcgaggtccgaggtgagctcggggaacgtcttcttgtacctgtcgaggtcgacgatgagcaccatgttgatgaactcctcgactgtggtcatgctgaggttcaggatgttgatgtcgttctctgcgaagtagttgcagacggcggcgatgattcctgtgtggtcttttcctacaagggtgacgacggttctgttggtcattgggatttgccttccttttctttgtaaatggcgtactccatcgaatctaggagtgcgtatagcgatgcctctataacgttttccgatacgccgacggtggtccagctgtgctggccgtcggtcgaggtgataagtaccctgacggtcgcggcggtggccgcctttccgtcgagcacacggaccttgtagtccgtcagtttgatcccgtctatgacggggaagaagtgcgacagggccttccttatggcgttgtcgagggcgtccacgggtccgttcccgtcggccgcggtgtgttcggtttttcctccgaggtcgctcaccttgatgctcgcctcggacgtgagtctcccgtccccgacggagtcgatgaacagacggaagccgcggaggtggaagacgggtctgatctcgttcctcatcttcctcacgaggagttcgaagctcgcgtccgccccttcgaattggtagccttccgattccagggatttgacgcggtcgacgatctgtttggaatcgtcgctctcctctatcccgagctccttcagcttctccgtgacgctcgccctcccggccatgtcggatacgaggatcctcctcctgttccctaccgaggaggggtcgatgtgctcgtaggtgcgggtgtccttggagagggcggatacatgcatcccgcccttgtgggcgaaggcgtcctctccgacgaacgggaggccgttgggacggatgacgttctccacctcggcgatgccggcggagaggtcggtgagtcctcccatgtccatgccgaggtccatccccagcttgagggccagtatgggcatgacggagcagaggtcggcgttgccgcacctctcccctatgccgttgacggtcccctgcaccatggtggcccccgcctccacggccgcaacggagttggctacggcgagtccgcagtcgttgtgggcatggatgcccaccggggtcccgtaggtcaggaggacgtcctctaccacctccgatatgcgttccggaagactccctccgttggtatcgcagaggacaagccagtcggcgcctgcctccacagccgccccgaggcacgccatggcgtactccctgttggcgtaatatccgtcgaagaagtgctccgcatcgaagacgacctccttgccggcgtccttgaggaagcggacggagtcggatatcatgtcaaggttctcttcgagtgtggtctgcagggcgtcggtgacgtggaagtcccacgtcttgccgaatatggtgcatacgggggcggaggatgcggtcaacgccttcaggttcgcatcgtccgaggcgtcggtgccgggtctgcgggtgctgccgaaggccgagagcttcgccgcggacagcttcggggggtcttcgaagaggcggtcgtccaccgggttggaccccggccatccgccttctatgtaggggatgccgaaggcgtccagccttctggcgatatccttcttgtcgtcggcggagaacgatatgccgttgccctgggcgccgtcgcgcagggacgtgtcgtagatgtatatctcacgcatgcccgtgtctctcgtccaatatcgctatcaggtcgctcagtatggccgaggccgtctctatcttccccgccccgcggccgttgatggtgatgggtccggcgaggtcggcgtcgatctgtgcgatgttgagggtcccggagatcccgagggggtgtcctgcgggtatgagcctcggggacacctcgagtttggtgtcggagacctccccgatgagcctgatgaccatgttgtgggatgcggcctgggccacggcgtcggccgttatctggctgatcccggtgatcttgacgtccttgaaggagacgtcccggtggaagacggagttggccaggatgacgcatttcgcggcggtgtcgtatccctccacgtcgttggtggggtccgtctccgcgtatcccagctgctgggcctccttgagggcctgctcgtagggctgtcccttgtccatcttgctcagtatgtagttgcaggtcccgttgaatatgcctcttatcgagcgtatgttctcgcctacgaggttctcgtggcagaggttgatgatgggcatggcccctccgacggtcccttcgaagcggaatttgcacccgttctccctggcgagtccgatgagcctcgagaactccagggcgagggggcccttgttgacggtgatgacgtccttcccgcactcgaaggcgtgggtgatgttcttcagaccgacccctccggtcttgatgtcggtgggggtgacctctatcaggaggtcgtagtccacggagtccaggacctccaggctgtccgtgtacctctcctccccgacggagcgggtctcctgcttcctcttcacgatctgggctaggtcgagtccctcggggtccttcgtcacggtcttggagtccatgacgcatacgaccttgggcacggcgccgtatctcccggtcaggaactccttcctcctcagcaggacctctgccacgccctggccgacggtcccgaatccggatatcaccaacgagaccatctcagagcccccttatgagcatgagtttgtcgcggtcgcaggaatggacgaagaaatcgtcgagcttgtccctctcctccacgcagcggagttcggcgctgatgagggcggtgcggttcccggaggcggacttgttgctggaatacccgacgtccaccgactcgaagttgacgatcttggacgcctggtctatgaggtcgtcgacgtatgccgcgttgaacttcccgagtaccatgtactcggtggtgatggtctcgtagaccgaccccatcttggagatgatgatgtccatggacttccagatggccttcagctggtcgagctgtccgctggtggacacctcgaacgtcacgctgacgaggatcctctggttgactatctgttcgcggtcgtggacgacgccgactatgttgccgtccaccattgatatgggctcgagggagccgaccaactgacccggtaggtctctcacgtagagctctgcgtttaccatcatttcgaatcaccggacatcgtccttcgatatggctcatcccatgattattataatataaaaaagaggaacaaaacggatgtagggagggacccatccgaacatattcggaatcttgattataccttcacaagggcatctttccagcatgtacaacagggtccttatcaccaccgacggcagcgagagcaatagggacgcggtggacagcgggctggaactggccagccggttcggttcctcggtgacggcgctgtgcgtcttcgacgtggggagttacggcaacatagcgcagacatacggtctcggcgacgagcgcgagtatatgataaaggcctgcgagggcgcgctcaagtatgtgatggagaagggtgaggagatggggctcgaggtgacgcccaagatcatagcggggcacccggccgagaccataatcgaggaatccaagaactacgacctggtggtctgcgggaccctcgggaagacgggtatgaagaggatgctcctgggaagtgtggcggagaaggtcgtaaggatgtcccagtgccccgtactcgtgtgcaggaacccggtggaggagtgagacgctggaagcggaggaccgttccgacctatgcccccgctgcgggacgcgtttcccgtgcggtgccaacttctgtctctcgtgcggcgagttccgcaggggattcgaacatacccagtacagcgaccgtgtgtccgaggggaccgtggacgagaggatcgaggaatgcggtctgaggcaggtgagggagtatacggcgcggcgcgtcaccgccgtcaccgcattcgccctctgggtctgggtcgtcctgagcgtgaccgagggggtggtcttcgtcctcgcacccgaggcggtcgcaggatcttatctgttctcggagaccctgttgttcgaaggtctgataatgctgtccagcggcgtatgtgcgctgatcggtgccctgttctgccaccggaagggtcaatggaacatagttgcggccgcatgtgccaccgcatccattatccccctgttgctcgtgccggccggggacatcgcaggtctcctgtatgcctcggtaggtctcgcggtgacgctgagggtcgtcaagaccaggtgggcgtccgcccgcctcgcctgaacccgcaggattgatgtatccaatctggcacatgtccatgggaggcgtaggcggagcctccgatcccgggtatgcgttcacgtcatacgaaaccatggttggtgttacgaacattggtaacttttattacttgaccggtcttacgggaccgcatgcgcaggatcgccatatacggcaagggcggaatagggaagtcgacgacatcctccaacataacggatgccctcgccgagagcgggaagaaggtcatccagatcggatgcgaccccaaggcggactccacgcgcctcctcaccggcaccgacaggccggtcaccgtcctcgaccttatgagggacggcagggaactcgtattggaggacttcgtacgcgagggcaggcacgggtgcctgtgcgtcgagtgcggagggccccgcccggggatgggctgtgcgggacgcggtatcatggccgccttcgccgagatggagaggctcgacgccatcgccgagtatgacccagacgtgataatatacgatgtcctgggggacgtcgtgtgcggcgggttcgccatgcctataaggaacggctacgcccgcgacgtcttcgtcgtgacctcgggggagatgatgtctctctacgcggccggcaacatcgccgaagccgtaaacgggttcaaggacgacggctacgcccgtttcggaggtctcatccagaactccaggaacgtgaaggacgaggattccctggtcgacgccatggcggcggagatcggcagcaggacggtattcaggctcccaaggagtccggaggtccagctgtgcgaggggaagggcaccaccgtcatatccggtgccccggactcggagatggcagaggaatacaggaggctggcacataccctcatggagctttcggaggatgtctccggaggcatgaggctaggcggccttgcgacaggttgtgattgcaatgactaaagggattatgatagcaggctacggcaccaggaaaggcaacttggaagagatcctcgagaggcaggccgcccgcatgagggcgaggggcatcgccaacgtatacatcggatacttccgcgtgagctccccctccatccccgaggccctcgagcagatggccgccgacggagtcgacgacgtcctcgtgatgccctactacatcgcagagggaaggctcacatacgagctcatccccggaaagctcggcatctccgggaatgtagggaccgtcgacgtcaaggggaagaacgtgaaggtccgcatggcccccgcattcgggaacaacccggtcctggccgacatcgtctgcgacagggtcgccgacgccggaggggacttcgacgacggggtcatggtcatcggccacggttccagggattccgtctccagcaacaaggacataatggagatgaacgcggaccgcctcaggaggagggggttcaagaacgtcgcctacaccttcaacgagttctgcgagcccaccatcgccgacgccgtcggatccctcgcggccgcaggggtggacaggataatcgccgtacctctgttcgtcgcgatgggtctgcacctcggcgaggaggtccccgagcagatcggcatccccgcctactcccagggaggggagataaccgcaggcgggaggaagatcgaggtcaggtacaccaggcccgtcgaggacgacgcccgccttctggagacgatggtcgccggagccaaaaacttctacggcatgtaagtgcatatggtgtccggggtaacatgaccaaaggagtactgttgataggctacggcacgcgcaagggcaacctggaggagatcctcggcagacagctggcaaggctggaggcccgtgggagggaccgggtctatctcgcgtacttcagggtgagcgagccctccatagaggacgcactgcgcaggatggccgccgacggcgtcgacgaggtcctcgccgtcccctactacatcgccgaggggaggctcacatacgagctcatccccgggaagatgggcgtacccatcggcggcaacggcgagaccgtcgtggacggcaggaaggtcagggtctccatgtccccggccttcggtatgacgcgcgtcctgttcaacatcctgtgcgacaggatagcggagtcgggatgcgggaaggacgacgggatcctcgtaataggccacgggtcccgcgacgtgagcagcagcaacagggcgatcatcgccatgaatgcggaccgtctgcgcaagatagggtattcccacgtggcctatgccttcaacgagttcgacgagcccgccataggggatgcggtgtccgggctcgtatcggaaggtgtggagaagatagcggtactccccctgttcatagccatgggggtccatctctgcgaggaggtcgcggagaagataggcatcccgccgtactccgacggcggggatatcgatgcgggcggaaggaaggtctccgtcagatacatgaggccggtcgaggacgacccccgcctgctcgagctgatagattcggagatagccgatttctacggtgactgaaatgaaggttctcattctcgatactgtgcacgggggcaaggtcctcgctagatcttatttggacaaaggtgacgaggtcaccgtggtcgacgtctacaaggtgacgccgaaggacatactgaacgacatccgccatatgggggctaaggtcgccgacgaggcgcccgccgaccatttcgacctggtggtcatgccctgccactgtcccgacgtcttcatcggggaggcgacgtacgagaagagggtcttcttctcggaggccgtgaaggacctcatccgcgaccgcaggttcaggatcgaggtgaccggggtcaagggaaagaccagcacctgttacgtgctggcacatatactgtccctcaccgggaggaaggtctatctgcatacctccagaggtatggggccctatgccaagggcaagcatttcatcaccgagctgaagtccatagcccctcccatgctcctcacactccccaaaggggagtacgacgtcatggtctgcgaggtctccctcggagggtccgggaaggcggacatcggctgcataaccaacctcctggaggattacggcatagccaagaacaccaggaaggcggaatccgcgaagaaggacgtcctgtgtgacggcgtcaacatcgtcccggaggcggagaaggacatctgggcgaagtacgggaagcccctcaggacctacgggaagagggtctcggtcgtcgggaggccggagttcgggaagcccctcgaggtctccgtcgactaccgcgggaaacacgaggtgtcgctgaggtccgactatctggcacttcagtatctcgatgcgatggacatggccctggaggtctgcgatgccatggacgtccccgcggagacggtcctggaaggcctccgtaccttcccaggtgtccccggaaggggggaggtctccgtcgagaagggggtcaggtacctgcgcgacaggaaccccggggtgtcccacatgtccgtggagaggaccctctcctgcctgaaggagatgggggccctcgacgatgcggtcctcataatagatccggtcagcaggaaggtctgcgacaagatggacaaggacctcatcggggaggtcgccgcgaagtacggcgtccccatggtcataaccgacgggaaggggtccgaggacgacgtccccgaagggaagaccatggtgatcaggatgttcaaggagggctaccagtgaacacggcggtcatccacccccgtcccaaccccatcgtggcggcgatgtacaccgtccgcgacatggatgtggacgtcatcgtactgcacgggcctgccggatgcagcttcatggcctccaggccgctcgagaacgcaggcgtcagggtggtgacctccgcgctgaaggacaacgacctcatattcggggggacggaacccctcgtcaggaccctcaaggaggtcaggaacaagttcaatccgaagaccgtcgccgtggtaggcacatgtgccagcaccataataggcgacgacatggccgccgccataaggagggccgacataggctgcaacgtcttccccgtggactgccacggatgcatggcggccaacaccgacggcgccataagggcgctgaaggccggggcgaaggccggcgtcatcccccaggaggaatgcgaccgtcagaccgccctcctcaaggcggccaccgagctggagaggcagaggggcatggcggccaggacgtacctgtcccccgccgtcagccccaccaagctccacgtgtgcaggcagatagccgatgcgctgaaggccgggaagaaggtcgcggtggtgatgctggccaagaaggagctcgcataccgtttcgccgacatgttcgtggccgtggacgaggcccgcaggaaactgggcgggaagacgttcttcgtggccaacatggacggttccgtaggtcttccgaggatcaggagatattgttccaacatcatggccgagctcgatgcggacggcgtctccatcgaccgtctcgtgggcggtctcgacgagtacgccgtggtcggggagaggatgaaggccgaggtggacgccttcgcccccgacatgacgatcttcctgggtatatgccacgcatatccggacctgaagaaggaggacatcctcataaccgaccagccgagggagctggccaactatctcaaccagaacttcctctccgcggtgggggaggtctcctcgcacaacatggtcatgggtgccaccggcatagtccatctggagactgccgataccctcagagagatcgtcagggagatgtgagatgaaaggcttcgtggtttccggtaccggcagcggggtcggaaagacgtcggtgacgaccgggcttctgtccctcctttccaaggggcgcaaggttcaggccttcaaggccgggcccgacttcattgaccccatgtaccacacggccgccaccggcaggcctgccaggaacctcgactccttcatgctggacgacgacaccatcaggaacgtggtcgggtacgcgtccaaggatgcggacctctgcgtcgtggagggcgtcagggggctgtacgaggggttcgccggcgacggcgacgtcggatcgaccgcctatgtggccaaactgctggggttcccggtggtgcttgtcgttgacgccggttcccttacgaggagcgcggcggccatcatcaacggtttccgttccttcgaccccgaggtgaagatcgcaggggtcatcctcaacaaggtgtccgggaggcagcactccgacaaactggatgtggccatggagacctactgcaaaggggtgaaggtcctcgggaagatccccaaggacagggagaacaccctgggacagagacatctgggtcttcagaccctgcactccttcgaacagaaggagatcgagcccttggagaggttggcggacccggtggacctggatatgctgatggggatcgcggaggaatgcaccgcggacctgccggattcgtccccctacgtccggaggaggtcggggctcaaggcggccgtcccgatggacgacgcatactccttctactaccgcgagaacatagagtgcctcgaggcatccggcatcgaggtgaggacgttcaggccggcggacggggaacatctcccggatgcggacatggcctatctgggcgggggatatccggagctctatgcggacaggatatcgtccaacagggatttcctggacgggttggagaacatgtgcgccgaggggaagcccatactcggggaatgcggaggtctgatgaccctgtgctcgtccatgacggacaagtccgggaaggaataccgtatgtcgggggtcttcgacgccaaggcggagttcgtggacaagaggcacggacccacctacgtccttgcggaggccaaaggcaacaaccccctgttctcgggacccatgaggggtcacgaataccattactccgaagtactggcacatgaggatgccgagttctgcttcgatataaggagggggctcggtatcagggacgggaaggacggtctggtcaggaacaacgccgtggggacctacatgcatcagcatgcgctgtcgtgcgacgactgggccaaggggttcgtggaatccgctcgctgagtatatccttcctctatgtctagggccttttccatcgcgccctcgcggtccccttccctgagcatgtgccagatgtcctcgtcgccgaggacctccgcgaggaactcggccctttcgggctgggaccctatcctgtctttcagatccttcctgagatccgtcaggagggagagcatcatgtcgtactcctcccccaggaatccgtcgatcttcttcgcgacataaggcgggaacgcgggtacggaaccttccgaggagaccgccaccgtgtaatgcttcttcctcacggaggacgggagcaggacgtcccctccgccgtgggcggagttcacgaggacgcccttggagcgggcggaatcccttatggcggcgttcagatccttgctgtcggtggcggccaccgctatgaacgcaccctccaggaagggcgatatgtcggacgggtcgaaatgttccaggacgatctcgtcgcatacatcttccattccggggacggtcctgtccgcgaccaccgttatgcggaacccttcgaactgccggcatttgcggtatgcgaccatacctcctccgaacacgacaaccttcctttctttcgtgggttcgaggaacaccgggaccattctcggggacataggcggtcaatcgcataatactatgataaatctttgacaggtccccggaatggcgatatggtcgtattggtaacacgaattattattttcttatgtacatatttaagtaggggctccgcgttatgtacttcgggcaggaggccggaaggcgctccatcgaatcctctgccatagacggttctccctttcccggaggttcctttacctccgttcctccgggacggcccaaggcccggactctaatctatcgttacatgtgccagactttgtaagtccgtacaaatcacagcgtcctccgaaggagatttttttaactctggcaggtcgtatcttctttcatggatcccggatccaaaaaggcggctatggagttcatagagaagttctatgagggagagagtacaggacacgattattggcatagcatacgtgtgtacaacatggcgatggccatatgcgatacggagccggaggccgaccgcgatatagtcggcatggcggcgttgctgcatgacctggacgaccggaagctgggcggcgacgatgagaacctcccggtggcctcgggattcctgaagacccatggggcgacccagtccgagacgaagaggataatcgagatcatccatcagatatccttcaagggggaggattcggtggtccccgcctgcatcgaggggaagatcgtccaagacgccgacaggttggatgccatcggggccatcgggatagcgaggacgttcgcatacggcggggcccacaagaggcccatatggaatccgaacaaccgtccgaaggagaagatgtccgccgaggaatactacggcagcagatccgacagcatcgcccacttctatgagaagctcctcaagctgaggagcatgatgaacacggacgaaggcaagcgcgtggcccagaggaggcacgattgcatgctgatttatctggatgagttcatggacgagtggaacgggaagagatgaatgggcagaaggccgtccagcatgggaaaatccctcttcaggggtgttccttctggatcggacatccgaaatgcttatatgtaaaatcataattgggtcagataagctcctgtagtgtagcggccaatcatgaagccctctcgaggcttcgacacgggtccaaatcccgtcgggagcacttctctacttctcttcgatggtcattctgcaactatgcttccggaccatactgtcttcgacatcgttcttatgggtcctgggtaggttctggaacaggcggcggatccgtcccgatatgcccgtcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaacattctcttctgaaatcaccgaatattattaatagccacacacatatgatcgattatggaggagatggaggagtatattcctcgtttggccgatgagcatctggagtttttattaaagacatcaggggcagtatatatcaaaggtccaaaatggtgtggtaaatctactaccgcaaaaaaacatgcaaaaagttgcgtctatatgcaagataaaatgacacaggatcagtctaaagctcttgcaaaaaactctccgtctatttttttgaaaggtgacacccctagattgattgacgaatggcagtcgattccttttatttgggattccattaggtttgagatagatcaaaggaataagtttggtcaatttttacttacaggatctgtggttccgaatgatgaagataatgaggagcgggagcacagcggtgcagggcgcatagttccgatggtccttcggacgatgtctttattcgaatccaaggatagtacaggggaagtgtccctgaagcagttattcgatggaaaagattttgaagccaaggtctcggatctttcattggaagactattcctacctgatatgtcgcggaggatggccaacagcagtcgttcacggtgaaaaggatacggcccttcaacaggtaaggaattattattctgttttgataagtgaagattttcaacgtatgagaaagaaaaaacgtggcacggagaaaatatctgctgtaatgatgagttatgctcgtaatactgcaaccaatgcatcaattgcgacaatatgtagagacatttctgtcgctggagaaaagaagatagatgaagatacggtaagagattacctttacgatttggatgcattatttgtaaaggaagagttgccagcatggaatccgaatctccggagtaagactactgtgaattgctctcctgtgagacatttcatcgatccatcgataggatgtgccgccttagatatctggcctgaagacttgataaacgatctggagacaatggggttattctttgagtcgatggtgattagagatctgaggatatatgcggaaaggttccgtgggcacgtctatcattatcgtgacggagacggtctggaggcggatgccgtgatcagaacaaacgatggcaggtgggccgcgatcgaagtcaaactttgtgattcggacaggatcgaggagggtgcgaaacatcttctggaactcaaggacaaggtgagactagatcgtcatcaggaaccggagttcctcatggtggtgacggccaccaattatgcatatcggcgtgaggacggggtcttcgtggtcccgttggggtgccttggcccgtgaatcctccgatcgggacaggccgtattctcaaaccgttttttagttattttactaaataatgttaattttctaggttaggcatttatatatgtaacatttggacaaaatagcgatctatttgcagagtgctgagaacagatatagcagcgtcctgcgcggggcgtctgccaagaagataaagcaatctctcgacgagcgtatcgacgagatccccgaccacaaggcctcgaccctggtcaatgcggccttcgcagcggatctgttcttcgtgatcctgacggttctcttcttcacgggccgcatcgaggagttcgagatcaccctgttcttcgtcccgataatcacatatgtcgttctggagagtccgggattccgcctcaggatgctggagaagcccacgtgggtggctttcgtggatatcgtatgcgccgccggcatcgttcttctgtgcatcgagaccgacaaggtactctgcgagggtgcggtcaacgacgtactttacgcagccctctatctcgcagtcatcgtcgtcctcatggagttcatctgcaggaacaagtgggcatattatctcatgatccccgtatccttcgtcttcggatccgctctggcgctccgctacatcccccagtacgaggtcctggcattgacggtgggtgcgatactcgccatctccatggtgatgtcttaccagtcccatgctttctatttcggtatcggcagggacgacagggtcttggaactggtggccgagggcagatggggcaacgagagtgcgatgaggaaggtgttctccgaggacgagatgcgcgcgatgctcttcaccaaggaaaagaaggccccgatctctaaagagtgacctcggccgtagtataatccagattagtctaatccaaattagaatgattcgaatgaagatcggtggctcaatggaattcatcggaagggaagaggaatcttccatattggagagggagtacggggagagaagcagccttgtgataatctatggtcgtcgcagagtaggtaagactgctttgatcgacaattttctaagggataaaaccgactcgatgtactttttagccacagaagaatccgtcgttttgaatttggaaaggttctcttcctccgtatcgggacttctggggataccgggtgccaggtttccggattgggagtccgctctcgacgcagccaccaagtatgggaagacggtcatagccatagacgaattccagtatctggcacagtccgatcccgcgatcccttccatattccagcacgcatgggatacgatactttcgaaaagggacgtcatgctcatcctatgtggttcgttcataggtatgatggagagatatactttgaactactcgagtcccctgtatgggaggaggacggcatctctgaagctgggtcctttgacgttctcggacgtgtgctccgtatcgaagggggtcgtgtatcgcgacctggttgagcgctatgccgtgaccggaggcgtcccccgttatatggagatcatgaacggatcatccctggaggatgatgtgtatcgtcatatcgtcagtcgcaacggcatcctgtacgaggaacccctgttcctgctcaaggacgaggtgaaggatccggtgaactacatcagcatcctccgcatgatcgccgccggcaaccgtaagatatcggacattgccgggaggatggaggtccccagtaatcgtatcagcccctatctcagcaccttgatagacatggggatcgtggaacgcatggtcccggtgacggagaacaatcctgaaagatgccgcaacgggatctaccgcataaaggacgggctgttcggtttctggttctctttcgtctatccttacaaggagtatctggataagggatacacgtctgcggccatggagaatttccgcacccgtttcgacgaggccttcgtaagtttcagattcgaggacgtgtgtcgcgagatcgccgcctgcgagttggagggatatacgaagacgggctcgtactggaacaaggatacggagatcgacgtcgtggccgtggaccccgatggcaggaggatattcgcaggagaatgcatgttccgcagggaggagaaggtcacgacgaaggtattggagctcctgaaggcgaagtgctcgaaggtgcgtgatttcgagggatactccatggaatacggactgttctccacatccggtttcgacgagaaccttaaggcgagggccgaggaggagggcgtgaggcttttcgacctttcgggaagtccgtaaacattcccgagcgaccggttttctcggaatccttcagaggaggtccatgttttttatccccccccctcccgggggatcgatgcgggcgatccccgaggtcgtcggggttgcaccggccgaccgttcagatctctcccgacgccttcatcttctggacgcggtcgagtgcctcccgcgcccccggatacccctgggcggccgaccggcgcaggagttcgacggccatggtgatgttgggttcggcggtctgtttcctcacgtgcatcatggccagacggtattgggcacgggcatcgcccttgctggcggccgaccggaaccactgttccgccttgcggaggtccttcaccgtgcctttgccgtcgtgatacatggccccgaccgtggtctgcgcttcgggaagttttctcttggccgcctcgtagtaccagcggaaagcctccttgtaatcgggatacgtcccctccccgcgctcgtacatgcgtccgagttcgtatttcgcctcggcagaggcgcatcccgcgacttcgaggagcattccgaaggcgcggtcctcgtccttggggacgccctgccctctgcggtacatcatggccactatggcctccgcctcgcagttgccctgttccgccgacttggagagccagaatacggccttctcgtcggacctcgtcacgccgaatccgtcgagatatcttcttccgatgtcgtactgggcctcttcgaggccgccttcggcggccagctctatccattcggcacattgctggggggacaggaggctgtattccatgccgatcccggcgacggcgtattccgtctccgggtctcccgacatgcggatctcggagaggtacctgtcggcggtctctatgtcgccggcctctatggccatgaaaaccttctcgacgagttcctcttccatctattcccaccgcggactgtatttcatgcgggaacgcggtcatctgcgataaagcagacggtcatcgcatcctcgaaagggtctcctttacaagacgcagggcgtccttcgcatccttcacgccctgtgcggcggacctctcgaagagggacatggcctcgtcgtagtccctctccaccccttcgccctccatgtagaggaggccgaggttgtactgcgcctcgggatgccccgcatccgcggcccggcggtaccattccgccgccttcttcgcatccttggtcgtgccgcggccggtgtaatacagaagtgccagatcgtattgggcctccgtcaccccctggtcggcggccatctcgtaccagtagaacgcctcctccatgtccagggggacgccctcccccatctcgtagaggctggcgaggttgtattgggcgccggagtatccgttgcgggcggacctttcgaaccattcggcggcggcctcgtcgtcctttccgacgccggtgccgtcgtggtacatgagcccgacctggttctgggcctgggggtggtcctgtccggccgccttcatgtaccaggacatggcgtcggtataggatacgtcggtgccgtaacccagatagtggaagttccccatctggtactgtgcttcggcgtagccctgttccgcggacctctccatccatgcgaacgccttccccggatccctctcgatgtccggacagtcgatgtgcatggtgccgacagtgaactgtgccagagggttcccgtgctcggcgctcgccaccatgcgtgcgtacgcttctctgtatcttcccgcgcggaagaggcgggaaccttcgacgaaatccccgtccctgcggcattgctctgtgaggtcgctcatatgtcaccgtgtaggggtccgagttcattaatcatgacggcccgtatacccgtcccctcggggacggaggtcacctgatccccttggccatctcccctttgacgaaggcgatcctcttctccgcgtcggcgacgccgaggtccctcgccttcaggaagtagtcgagggccttctggtaggacctctcgaccccgtcgccctccagatataggacgccggtgtcgtagcaggcgtcggggtgtccgttgtcggccgcctctatgcatagtttggcggccttcccgacgtccttcgcacatccgtacccgttgtggtacatatgtgccagacagtaggcggcctgcaccactccgcggtccgcggcctgggcgtacagctccacggcctgcttgtagtcggtcgggaccccgtcccccctctcgtacatggtgccgaggttgtagaacgcctgtgcgtatccctggttggcggatgccttgagccactcgaaggccttcgcatcggacctctgggtcccgttccccaggtggaacatgacgcccacctcgttctgggcggcggcgttgccggcgacggcggccttcctgtaccacatgagggccttcttcgggtcggcctccgtgcccctcccgtagtagaagagtccgccgagacggacctgggcctccgggttgccgttcatggaggaggtcaggtagtggtcgaacgcccctttccagtcctccgccttgaagcactcgatccccgccgtcagctccgggtccttcatataggattcgaaatcgtagtccgacattcactgcgccctcctttcctcctcctcgatcatcctgatgttgtccctggccttcacgaacccgagctcgaacgccctctggaagtacttcttcgccttcccgaggtccctctcggtcccgtccccgtagaggtacaggacggcggtgtcgtacactgccttcgcatagccctcctcggcggcggtcctgcacaggaggaacgccttggcggggtccttctccacccccttcccttcgtggtagaggtggccgaggctgtaggccgcctcgggcatgcccatggaggccgccttcagatacaggagggaggcgtactcgaagttcacctcgcatccgcatccgctctcgtagaacgtcccgaggttgtagatggcgctgcggttgttctgctccgcggccttctcggtccactcgaaggccttggccggggagcgctgggtgttcctgccggtggcgtacatgaggccgagttcgttctgggcgtcggcgttgccgttctccgcccccttgcggaaccacatgagggccttcttgaggtcctgtctcgtaccgatcccatagtagagcatgttcccgatgcggaactgggcctccgcattgccgttctcggcactcctcatgaaacatccgaatgcgttcgcgaagtccttttcctcgaacgccttctttcccgcatcgaagtcggcgtccgtcttctcttctgacatagtgggacgtaaagcggtcggtcgtattttacagtggttccgaatccaggcgttcacgccatgccgccgcgggcggcggcgctgatgtattcccatgccttctcggaggagtattcgacgccggtcccctcctgatacatccttccgagggcgagttgggagtacgggtcccccatatccgccgccttgcggtagatctgtgccgccctccgggcgtcggcgggggcgaagtcgccctccaggaacatgcgtcccagttcgcggagggtgtcgacgtccccgctgagctcggcgctgtagtacagcgccatcgcggtgcggacgttcctttcgacgccctggccgacgtagtagaggcggccgaggcggaggcaggaggggccgtctccctgcatgaccttggaggtcagggattcgataactttcatcatgttagatgatagggatcgtcggatatatatcatgtaacatgttattaacagatatattgtataatgacctcgcgatgctggcacatcgcgaggtaaagggtcacgatgtcttcatgacgggacgggaatgttcagttcccgccctgcggcatggtctttttagagacctcgcctatgcgggcgaaggcctccccgtcgaggacgacggaggcgtccttcccaccgagacgcatctccacgacgatccccgcatccgagaagtcgaggcccgtgagtatgtccgcgaatccgggagggaccccgtccgcatccccggacgccgccttggaggcggcttcgaacatcccgggtacggctttggcggtcctcggcccgtgcaggaagcgtatgtcggaaccgtccacacgcatcatcacgtcgccgaggacgttgtatgcctccgtcccgtcgcacacggccgcggtcatgtcgcggtgggtgcctatgagccattccatgacggcggcggggatcatgccgtccccgacgcctctgacggtgtattcgacggaggcgcctgcggcggtttcagcgttctcgatgtcggcgaggacctcctccggggagcgcccctctacgcgtgagacggtgttcaggatctgtctcacgttgacggcataggtggcgaagtccgtgttcgccgggacgaggatctcctcgtcccccatgctgtacgaatcgtacgatcccggggcggagaaggtcatcctccaatccttttcctcgagatatgtcctgatcttgcgggggtccaccttcatgaggacccctctgtcgaatcctgcgttcatcttcatccctgtccttccgagcgcctgcagggcgccgtagatacgcgttccgaagagccagcgtgatttaagcgttatccgtgccggtacgctgtcggaccgcccatgggcggccgccctttgttacatccgggttcccgggacggtctcagatcccgactatctcgaccttgaccttcgggaccttgacccagaagcttatgccgaagaggacgaccctgcccttcatccccatgtagtacttcctctcgtgtatctgcgatatggcaccatcggcatcggcctccaggtccttttccgatgcggacctcttgagttcgaagatcatcggtacggtgcccccgtccctgggtctcatgattatgtcggtccgtccgtttccggattcgcatttggtcttcatgtttcccgggtcttcggccgtcgcggtctcgccgtccggggagggcccggtaccggatatgtccggaccccggaccgatggtgccgcactcacccattcagttcgcccagggcctcgacggcctcggggatgccggccttggccgccttcccgagccatttcctcgcctcgcggtcgtccttctgcaccccgagcctgtcgatgtacatggtccccagcaggtactgggagaaagggtcacctctgtcggcggccttccggaggaccacggcggcgcggacgtatcttccggattcgtagtagaagagtcccagacgggagaggacggcggtgtcctcggaacgttcggagagggacaggagctcctcccccttcctctcgtccttctccgtccctcttccctcggccacgcacatggcctcgtggagggcgcccatggcggagccgtgctccgcggcgcgggagaagaggtcgaaggcggtctcctcgtccttctctacccccagcccctccatgtagtcgtagccgaggttgtattcggcgtcgccgaatccctgggaggcggccgcggagaaccagttgttggcctcctccaggtccttctccaccccctccccggaggcgtagagggtcccgacgaaggactggacctccgggtccccttcctcggcgtattggaggaggacggggacgctgtgttccatgtcccctttcctgaacagttcgaaggcttgttccagttccgggtcggctgtcatgggcggaggaagattgtatgcgatattaaggttggtcggtcgtttttccaatctccatatgtccattatcaggtgcgggagccgtcggaccgactattgggagcggttctattgtcagagaccgtcttttatccactgacatagaagatgtggttggagatggatttaaattttggatatattttgtattccttttggtttcaatagcctttggaggtcatttttagatgagatccatagtagagacgggagctgaatgtatttgaccagagagaaccgttacaatctaatcatcagctttcagggtgaatatgtatccggtttgtaaatgttgcctggacagggacttggcagccgagttatatgtaatgttctttacaagagatggataaaggcaatctgatattgcttccaatgaactatcacgattttgttcagctttttcaagtaaatctttccaactgtggtgctatatttcgttattgaattagattcattgaatcgtattacatgagtctaactggcatgggttttgaaataacatcgtaaatgatctatattggttaagaggtagttgtattgttatggatgccacttcatctataaagtcgaaattagttatggataagtcgtttaagggcgtattagaaaaattgagtaattcaaacatatctttgcctactagttcgacattagtagagggcaatatcgatttagactctacagaatatttgattaagtgtattgagccatcggaaaaatatcctctaaatgtgcggaatggatactctgtggcaataagagaaggaacagtaattgcagcttatgatgagtcgtttaagacatatgctgcgttagaaggaaaggcagtttgtgcatcacactctttggttattgttagagattccgattatgttccaattagttttctaacactgaaattttacactcgttctgatggggtaaaagataagcttggagatgctgcaattgttgcagacaatgtagaccatagaataaatgtggatatggccttagataaaatgcaattgctggatgaatattgtggggacaattggattttgtttatcgacggccccttggtgggaggagattcatatacaacatttatgccgcagattcaaaagtttttagaaaaaggcataatgcctatattctgtgttaagaatagtagtagcaatcttgtaactcaatatcttcccgaatacaagggtgtttacaattcagatatgcattgggcgaataatcttctaaaacaaggagagagaacagcattttttgagtatatagattcgcataattcgagtaattccaaagtgttttgttacataaaattcttagacaagtgcagtccagtaagagtagagatccctacgtgtatatatcggaaatattggagctccattgccgattgtatggaccttaccttgtatttgattttagcacaaggtaatgaaaaaaatgcacaggtaagacctattgcgattgcagagatgtttgctcgggaaacgcttcatctgattgatctaaatcaagaaatcaggcggtcaaaacttacagaaactatgaatcaagcgaggtggggagacgatgatttggacagtactcaatgaaacagaccagaagataaagcttgtatcaaaaggatctacagatggaattcttccgaaggggtcatttttgactgttgaggataataaatctaaacgcaagtttatattgagagtggacgagagtaaacaagttgttccctattctccctcgccacttctttcagacatggatctggagtatttggaagctgataagaaatgcaagaatgagattacagcctatcgtgtgaaagatgtatttgaacgcgatgatggaatggttgattttatccatccaaccagtccggcaagaagatcttctcaagaggaaatcaatcttgcaatgggtatgggagataaggggccaaaagtattcgtctccactgttcattcaaatcaaaacagggtgttgagggatgaatcagggaaacacattactgcaactcttccaagtgactttttctatcaccaaactttgatatgtggaaagacaggcagtggaaaaactgttgctatgaagtatcttgcgcaatactttattgaagaaattaaaggtgcagttctcgcagtgaatgtaaaggatattgattttttacaaatggatagagcctctgtgtcagatgatgaggctgtattgtcggagtggaagtctcttggcatgagcccacacggcgtaagcaatgttactatgtatatgccagcgaatcgtagatatgagagcgtaaaaggaataaactacgacatttgtagaaagataactttagatgtcaatcagattcagccagaggcacttactggtttgttgcaaggaatttctgataagggtgcattgaatctccctggcatattcagatattggagacagtatgaggctgaaaagggtaaggccagatttaccgaatttgtaaaatattttaacagtaaagaagactcgaaaagatttacatcaatcagcgatcgtggtgaggagacaccagttaccattcatccaggaacatatgacaacatatctagaagtttggagtcggctatcgatttctttgataactcttctgcagattctttggactatgatgatgttcttcagcagggaaaaatgagcatcttggatttctctggggataaggggccgaggtttggctctatattgcttcgtgatctgcttaaaaagattgtagatgcaaaagatgcgatgatgagtaaagttccaatcctgataataatagatgaggttcatcagttttacagtacagattcctcaagagaagctctggatgatattgagaggatttgcaggacaggaagaagtaaagagataggtgtaatttttgcatcgcaaagtattgaggatatccctaaaggaatcccatcggtagtcaatactcagatatttttcaaaacagattcaagttcattgaaaagcattggtgtgaaaataagccctgaagaattggaaggtcttagaaaaggatttgcaatagcatccatacatgatcttccgcaattgaagattcttaaattcccactgtctctgtgcggagttgttaaaaatgaatgagtgtgaaacaagtaattccttggagtatctcaaaagtattggaaatactgcacttcagaaaaagataattgagattttggaacagtatggtaatacgagcgaggctttggataaaatcatcgagtatgtagagagtgagtgctgatgattgattatgactatagactaaccattgacatggggactaaaaagccaacatatgttccagatgatgaatacaagggccctctgaagaatatattcagaatagagggacccaacatgtcagggaaaagtactctgatgaatctcatagctatttctgcatttggtcttaaaaacaaatcagtaaacaaggttcttcaaaagcatctagatgacatggttcatgataagtctacggaattgacattttgtgtaaatatcgttgatccagtttccggaagagccataagagctactcgcaattctccggatgccgacattttaatcgaagattcagacgatgggaagaatttttcaccaatttccgatgatagtttctctagaaaatacaacttgatttatgatattcccgataaccccattgataggttggcagatatttctcatgagatcagtgtaattcatcaaaattgtagttcaaaattaaattcatttcagtctactgttgatcatttgatttatgacataagcaacggtcccgatgaagagttattgaaacaatatagggctgaagtggaaaagtatgataaaaacaatggaaaagatgttgattgtgaaaataagaaaaagaaatatcagaaccttgccaaattgtattatgcaattcgtataagggatgctaataaaaaagcggatgatttgaaaagaacatatgattttgttaaaaaagaggaagaaaagaaaaaaacacgcccccaagatatcaagaagagttatgatgcagatattgctgctatcagggttgccgcaattccactaagttctgcacaaatcgctcaattgagtcgtgatgtttcagctttaggaaatctgagtgtttctgaagcatttgaagttatttccgagtttgacattggtgaagtaattgcaaaaaaatctgttccagtaaaatactttgatgcaatttctaaaatcgagagagaaatatctgtcgaagacatccacgaagagaattctacaatcaatgcaatgctcgatataatcaatgttttgagaaaatatgagaatgagaatattaacattccagatcttgggtctcttaataatcttctgtctaagttggaaagggattatcaggtacaaagtagatctattggtgttgtttcatcttctaaaaggattttagaaaaagtaggtaaaatccggacaactcttatcgatatcgacggcaaggttggaaaattaaaacctcctgtaaaagaggatgttggtgaacaatactatgataaatttagagtcgagtctgaagaaaggaagtggcgtaatgctaagaatgagttgactacaatttgttcagaggcatctaaatttggtgtagatttatccaactatgcaacagagcaaagcaaggctaatgcagaactaggtcatgtatacgatcgggcccaggtttctgatatattcaatgcaatgtcttctgaagagaaagagtataagagtgccatcgaatctgaaaagaaaaatacggagcgcattggtgctttcagagcgtatatttccaaaatggaaaatgttgaaaagagtccatacgctgagcacatcaatgctctgaataaaatttcaacatctcttatggcattaaagggcataattgataaagatatgaagatgttgactcaagttgaaaaaaagtcatatggaccatatgaccctgaggatccatttttcaagtccgtttggacatatctgggaaaacgtgtggggtttgttagatatggtcaagatacatatccaataagatatgtgaatactgtggacgatataattactgctacagatgggacaattcttagacttagacagataagcactggtttgaaccaacgtaattatttgatgtctaaacttcagactgacgatgaccgcccaataattgctttatttgatgaggtatcaacgatgaccaataagacccaggaggacatatttgagaaattcgttgagttgcagaaacagggaaaattaatggtcggtatgatgaatatgccctccgatgaaagaaaggtgacttcttttggacaataaaatggatgataatctagaatcacttgttcaagtcatgtattcatcctgtcagggtggcctagatctgaaaaaatatggaaactccctgctattttatctttttagatctagtgccaattctcgttcagaagcattgagaaaatcggaagaagttgtcatgacttccaatgaggctgaatgtttgaagaatcttggcttgataaggaatggccctagccttgggcattatgtgttaactgcgaaaggggtttggttttgcgagaaagatatcattggaaatgatgtgctcatagacttaattgatagagattattttaaaaccctgtcaaaagaagaacatctcaatgataagttaaaagtagttcttgcagtagctatcgcatcgagaacatacagtaaacaggcattaatttcgatgcgcgtagaggatgatcttcgtgacaggtggtggggtctgttccaagagatgagtacatttttacataccaattgcatcatcaaaacagatccgataaacacatataaatcgtcatctagcatagaagatcgtagtagtgacattatacgtcatactgattctatgcccagattaacaagatccatattctctaaaactggaaagaatggatattatcttgatattatggatgaatcaggagttccagttattgaaagattggcatatgttataaacgttgtattcgaagacaatctgaatgtaagcaatattgaggatattgcaagatatatgattttattctttagaaaaaatgttgtagagattgcatacagtaccttcgaagaacaatatggcgacatatcatatgaccaggtgattcataaggccttctacatggctatggaaaatcgtggaaaattgatggtttgacctctgagtaaactatttcttttattttatatttctgtaacacgtttgcctgcttatgactggcgttgttatttgtgattgtcccttctgcggcggccgtgacacatccgacctcaagtcctgccgggacgaggacggggcgcatgtcgaggtctaccaatgcgtctgcgggtgcaggttctccgtcaccctcgaggtcctcgaacacccctcccgccgaggctacatttaagccatcctccctcctccccgtcacatcatgtccatcgaagtaaggtccttccgtccctccgacgcggagcaggcggcctttgtctggaactccgtcgtcgaggaaggcgacgccttcccccaggaggagaccctcaccgtgcccgaggccgtggagttcttccaatcccagtcgtacaccggcgtcgccgccgacaccgacaccggcgaggtcctggggctctacatcctccaccccaacaacgtcggccgctgcgggcacatcgccaactgcagctacgccgtccgtcccgacgtccgcgggagacatgtggggagcctcctcgtggccgactccaaggagacggcccgggagaaggggttccgcataatccagttcaacgccgtcgtggccaccaacgcccccgcgctcgccctctacaggaagatggggttctcccaactgggcaccgtccccggcggtttccgcacgaaggacggacgttacgaggacataatcctccactacatcgtactgtgacaagggttctgacgatctctccgtatttttaaactgtttaaataccgtttataaatacaacgcgggcatccattaaaatccccgtccccctagacgtccccatggacgaggcagacatctcccggatgaacgacatcgaactgcagaaggaatacggccgcatgaaggcccgtctgtccaaggacggggggcgggatcccgaggggtaccgtcgtctggaggccgtctccgaggagatggaccgccgccggagggccgtccgcgaggagtacttccgcgacctgcgcgaggagacggaccccctttcccccctgggcatggagtgttacgtctgcggccgcaccgtggagcagttcaacgacttcgtgaggcggaacgccgaggccgacttcgacagcatcatggcctccgaccgccgcctccgcttcctggccgacgtacatgcccgggccgtccccaccgggcgcgagaaggcggtcatgagggacttcctggacggatgtgccagggcctcccgcgacatctccttcgccctggagaacagggactacctcttcgtcctcatggacggggagttcctccgtacgttctccgcctgggacatcgaccggtacaggtccgccgacgcggacgggatccccctcaccgcctacgagcgggacgtcctcggcgccttcttctccgccttcggcgacgggatgaccgtgggcgagtatgcggacagcatgcgctccctcacggagaggttccgttccatggtggactacgaggacgacccggagggctaccggagggccctgagggagaagtacgtggaggacaacacggtgggatgcttcgagacgggccgtttcggcgggatgaggatcttcatgtgccccgtctgcaacgggatcctcgagaccatctccgatacggaggaccgtctgcggaggaggatggggaagtcctccccatccgatggcaccaccctttaaaccatcctcctcatagcctcccccatggaaaagacgtcctccggaggcttgaacgtgatcgacagggacggcgtctacggcgtcctcgcggaggacgggacgttctcgcccgtgtatagagtcccggaggaggcgtcccctccggggaccccccgctggacctccgacctcggggagcacgtctgggactcctgcgtcgccttcgtcaggcatgcggagcgccccgcccacttcctcagggactccgacggcatcggcgtcaccgacctcaccgacagggggagggaggacgcccgccgcctcggcaccctcctgaggggctacgacgtctccctctcctccagtcccgtcccccgctgcgtctccacctgcgtctccgtcgcggagggcctcgggagggacctccccgtggagaggagggaggaggtcgggggctacggcaccgccctgtacctcgacggctacgccggtcacgtgtaccgggagccgggcaccaccgccgtcctcgggaacctctccggccgtcccatagagggatggcaccccttggaggagtgcgtccggaggatgatggatgtcatcctccccttcctgtcccgggagggcgtgctgacgctctgcgtcagccacgacctcttcgtcgcccagctcgtaggcggtaccgtcgggaggttcccctccgaccggtggatatcctatctggacgggatcctggtgtgcaggcggggggaggagacgtacgtggtgtgggagggggaggagcacccttatgccggcccccttcccgcggcggacatctcccccgcatcccctccccgcagggtcgtcctcccgccctcaggtcccctccccgaggtgaggttctccgcccccggcgacatcgtgtgggcgggccccccgagcgacggcaagagcctcctcgtcgactcccgcgggtatttccgccacgtccgcgccgacggctatccggtgtacggccggacatacgactgggcgggcgatttcagggacggggtggcccctgtagccgtcgagggggtcggcgccaccttcgtgacggacttcggggacctcctccacaacaggtggttccgcgaggtcaggggataccgcgaaggcgtcgcggccgtcagggacgggaagggatggttccacatcggcatggacggggagcccctgtatccggagaggtacgactcggtcaccgacgccgagggcgggagatgtctctgcacctccggcggtgtcgccgtcgagaggatactggccccggtctcggacgagcctatgggtccgtaagtccggatcccgaccgtgtggaaggtacggcgaagagtgcgtgggggtccgcacaaggcgatgtcatcagacgtgggaattctccatctggcacattgtgctgagaacatgggggccccatgaaggggacagtacatctcctccataggaatcatgtttataactcatgaaatgacatatgcattcatgaagggggaaggcaggttgttggcgatccccggcggtgtggacgatttcagggagatccgcgaagggggatattatttcgtagacaagtccgaactggtctcggatatcgtcaacgacaggtccaaggtcttcctcttcacaagacccagacgcttcgggaagtccctcaacctctccatgatcgacgccttcttcaatctggagtacaaaggcaacaagtggttcgacgggctgaaggtaaattcccatccggaggtggaggaacataggaacgcatatcccgttatccgcctctgcatgaaagacctgttcgttagcaggcgcgacatgttccttccgatgttcaaagggatgctgtccaggacgttccgtccgttcgaatacctcaagacgtcggataagatatccgaatccctccgcgacctgtatctcgggaaggatccggtgtatttcgaggatgcgagggccttggatttcatacctgcattgtgccagatgctggaacagcaccatggggtgaaaccgatagtcctcatcgacgagtacgacaatcccatcaacaacgcgttcaacaaggacacctatgactatgtcgtaggtttcattcgcgagttctactcgcttgtactcaaaagtaacccgcacatgagtttcgccgtcgtaacgggcgtgatgcagatagccaaggagagcatattctccggtctcaacaacctcagggtcgacaacgtcttctccaagaaattcgacgagaggtacgggttcaccgaaccggaggtcaaagacctatgttcatattacggccatccggagaagttcgaggaggccaaggagtggtacgacggatacaggttcggtgatgccgatgtgtacaacccttggagccttctcacctacatatacaacgatttcgagcccggcacctactgggccgacaccagcgggaacgacatcctggagaccttcctggacggtctggacgacagtacctacggggacctcgtcgccctcgggaacgggaagacggtctccaaacagatctacccatcggtatccatgagggacgtgggcggagacctggacgccgtatactcgatcatggccgtgaccgggtacctcaacgccgtccccaagggagacagcgattaccgcctgtccatccccaaccgcgagttgtacaaggttttctacgagaacgtcaccaggtccctgaagatggatgtgggagtcgcgatgaggaggttcctgggttccatggagaggaaggacgtcccgaagatggaggagagcctgttcatgctgttctcgaagaacttcttcgacatcctgctgagggacgaggccgactaccggctcgttctggcgaccatcgccctggggaggggaggcagatacgacgtgggcatcgagagggaggccggcaacggcagggccgacattataatgcgccgcaacgatccgagatatccgaacatcgtcgtcgaactcaagaagagcaggagcgacgacccgggcgacctggaaaggatggcggaggaggggctcagacagatcaggaccagggagtactaccgcagtctcaaggggaagacatacctctacggagtgtgtctccagaacaagaaggcgaaggtcctgttcgaggagatggacctctgaggctgtttttccgccctcatcctaccaaacatttttaatcaagtatcagatacgacggctaacggccgagatagcccagcccggtaagacgcaagcctggaaagcttgtgggagtattccctcgggagttcaaatctccctctcggcgccatgtttcttcacaaattaccatcgatacccatcctgcggacgctgtatccctccgaggtgcatctactatggaaaaggacgagatcgagatatcgggcgcatgcgagaacaatctcaagaacgtgagtctcagcatcccgaagaacaagttggtcgtcatagccggggtatccggttccgggaagtcctcgctcgccttcgacaccatcgcagtcgagagcagccgtcagtggcaggcctcctatcctctgtacctgaggaacaggatgccccgctacgagcgtcccgccgtcgaccgcatcaggaatctgaccccctccatcgtcgtcgaccagaaggtcgtcggtgccaactcccgttccaccgtaggcaccgtcaccgacatagcgcccctcatgaggctcctcttctcccgggtcggcaggccctccgccggcgccgccctctgctactccttcaatcatccgctgggcatgtgtcccgactgcaacggtctcgggaggaggctcgtcctggacgagtcgagactgttcgacgtcgaccgcagcatcaacgagaacgccatcctcttcacccagttctccaccgggtcgtggcagggttggctctattaccactgtcccctcctggatcccgccaagaagctccgcgactacacccccgaggaatggaagaacctcaagtacggccccgacgagaaggtcaagatgatgtacgtcagcaacaacaccgggctgggacagtacacggactacgagggggtggtccccagattctacaggctgtatctgaagagggacatatcccagctgagcaggaagatcagggacgaggtcatgaggttcgtaatcgacggtccctgcgcctcctgcggggggtcgggtctgaaccccaaggccctcgcatcgaggataggcggatacaacatccaggatctctacgacatgcaggtctccgacctcataggcgtcctggaggacatagacgacccggtggggacccctatctccaggcagataaccgaatgtctggaacatatggtggacgtgggtctggggtacctgagcctctcccggaggaccgacaccctgtcgggaggggaggcccagaggctgaagatggtgaggcatctcgggagcagcctctccaacataacatacatcttcgacgagcccaccgccgggctccaccccgaggatgccgaccggatcgggaggctcctcctggacctgagggacaaacacaacaccgtcctcgtggtggagcacaaccgtgcgatgatagagctcgccgaccgcgtgatagagatcggtcccctggccggatcccgcggaggggaggtggtcttcgagggcaccccggcggagctgagggacgccgggacctacaccgccgaatccctccgggaggggatatccgtcaaccggcacccccttccgtggaccgaggggttcgagatgaaggatgtgaacctccacaacctccgccacgtggacgtgaccatccccaaaggggtcctcacggccgtgacgggtgtggccggctccggcaagagcagcctggtcgtccagaggttctccgaactgtatccggacgccatagtcatcgaccagaagcccataggggtctcctcccgttccacccccgccacctacacgggtgtcatggacgagatcaggaggctcttcgggaaggagaacggcgtcgggccggagtggttcagcttcaactccaaaggcggatgtcccgtatgcaaggggaagggggagatcgtcccggacgtcgccttcgccgaccccgtggccatcctgtgcgagcagtgtcagggaaggagatacaacccccaggccctgggctacacctacaaggggaagaacatcgaggaggtcctcggtctgacggtcgagcaggccatggacttcttcgccgacgacaggaagatcaggaagggcctgcagtgcctggtggacgtgggcatggggtacatgaccctcgggcagaacacctcgtctctctcgggaggggagaaccagaggctgaagctggcgtccgagctggggcggaaggggaggacctacgtactcgacgaacccaccaccggtctccattccaaggatgtgaagcatctgctggcactgttcagggggatggtggcggacggcaacacggtgatagtggtggagcacaggctggagatgatatcccaggcggactgggtcatagacatgggtcccgagggagggaatctcgggggcagggtactgttctgcgggacgcccgcggacctgctggagttcgaggggtcgtacacggcggaacatctgaggaaggcggtcggccgttccggatgacatgtgtacacatgcattccggatcatcggccttccgcagtacctttcaagaacggtgcggactcccgacgaccggggatccgtatccggaggccgctggcgatatgtgtcgaagaggaggacggccgacaggaggtatgccgtccatcgttttcctgtatccttttttctttcttccaatccatccttcaaatgtattaaatacgatgtgattatgtagaaaaaatgatattggatatatatcccaatatcgcggaagaccgttgattaagtctggatagtgtgggcggacgcatcatcggtctcctcagacggctatttactcctgccgtggactctctcctcacaagaaccggcccgagcacttcactgccaaggcgggtccggagaccgtccccctctatgctctctttcctgggtggggacggtctccgggagttcgaatatctggcctgcatatgtcagcagtctgttttttaaatcctgaatcccaacatatccgcagcgtcctgcccaggggagcatagggggcgtacggagacgcgtccccggaggagacttccggcagggtcccgaaacaggagcatatcgacgggactgacgcaaattgtcatatacggtattgttcgagggtgagggatgcgaggacctcgcggacgtggtcgcgaaggccacggagtatttcgattcggtctgcacctcgtagatgggggaggatatgacggacctggtggtgtggatcagggagaacgcccccgggtgctccaagaccgatcccgacgccgccgcggatgcgctcatgggcacgccttacgtgcatgggcgcggatattcccgctgggacgtcctgaaggccatgatggtggccgtatagagcaagcgtttcatcggcggcatgaaggcacagataaagaaggcgtcggcggtcgcggagaggctcggctatgcggagagggtcaggtattccccccgtatagacacggaggggctcttccccgagccgaagatagaggtcctcgtcgacaggacgtcatgagtcctcctccgtcccgtgcccctcggccataccgcagaggaccctccacagcctctccttggagaagtccctgaagcggcaggccccgtccatgaggcgcctcagcgcagggcatcccgcctttctcccgacgacccgtgcgttcatgccctcgaccaacggcgatatgccggccaggaccctgtcgtccgcgtcccccggcaggcggttcttgtgtcctccgtagaatacgaggaccctcccgtcctccagcttgaacgacatcagggagtcgcagcccttcccttcgacggtgacgttccccgaggcggcatacctcacggggatatccgcccctatgtcccccctcccctgcagcaggtccgcggcggcgagacggaagagctccgtcagcagggggcacctcacatgcttcgaatcggatacgaaggtgtcgcatcccctgctccactcctccccttccagaaggaagcgcctcctcgccgagggggacagggtgatgagggccaggatcggtaggacgatctcctcgtccacgaactgggggtacccgtcggcgaaccatctgccgatgtaccaggattcctcctcgcactcggctggcctcacggcctccccgcgggcggagagctgtccgtaatgggaggcgacgcaatcggaccccagggataccagggcctccctctccgcatcggtcagatggagtccggacgcccaggactcgcggcggagacgattccccgggtccatggagaaacggtcctccatggggacggaggacagcccgtcctccccggccgcatcctccatcctctgcatgtcccccaggaaggagtcgacgacgtcgatcacatgttccagatatgccaggttggcttccttgcaaccggtgcggtcgggcagggaccctccctccaccatcccctccctcgcctcgggatagagggcgaggaagacctcctcctcgtccatctgggacagtgtatcggagaggcgcatgaggcggtcctggaaatccatgaacggaccttggtcctcgtacacgcggagatatctgcccacgagggcggagttgatgggatacgaggtcccggtcccggggctctcgagggacaccgtgaccgtcaccccgttcctcctcaggacgtccaggacgagctggcggtccaggaccatgtgggcgtatgcggaggcgcagagggggccgtcctgccctgtctgtggcggcagggtcctcacaagtgccagacacccgtccgtggattcttcggggaggtagaggacgcggttgcgggcgttcttggatccgcagcggaccagcacccccttctcgcatagagattgcaggatgcgcctcaccgcctggtagttctgcatccgcggagggagcgcccccgtcacgcctttcgcgtcgttgaggcggtatccgcgcggatactcccttccgcccccgtccccggggaagaacgtctccgcggcgtcctccccgacgagggaggagagggcctcgtaacgtttcgattcgctcttgaaatcggtcacagggcgcgaatatacagtatacaggaaatggtgcaggataagacccagcatcctgtcgcggccgtcatccatgtgtcgggaggatgccgtttcagtttataatatatgcttcggattatgataaactgagtatccggcataccagtgtattaaatcaggagaagtccttgttccacctatgaagatcaactacaagccgaacgggggaggccccgcgaagaggaacccgccgaagcagtgggaggtctggctggcggatgcgcctttcggcgccgaagggaagaagcgttgccccgtcctcgtcggcaagaggggaggcatgagttatgccgtctacgagataatcccgtcgtcgctgaggggagggcaggacgtggtcataacggacctcctcagatgcggtctggaaaagccctccgccgtaagggtgaggtcttccgccagcatcgagatgaacgccttcgtgcagaagatgggggacctcgaccaggcggacatatcgaaatgcatatccgccatgaggtgaaaaaggggggtcaatcgcccctgatgtccttcaggacctccacggcgctctcttcgccgtggcgggccgcccttttgaggtatttgacggccagtttctccgacgcctcgaccccgtcccccgagatatacagtctcccgagttcgagttccgccttgggatacatctgttccgcggcctttatcagccattcggccgccttgacctcgtccttctggaccccgagtccctgcgaatatatcctgtaaaggctgtactggctcttgtagtatccctgatccgccgatttcctgaaccatacgatggcgtcctcatacgactgttggatgccgtcgccggtggcgtatgcggtggcgaggttgtgctgggccttcacctcgcctccctccgcggccttggcccaccacttgaccgcctcctgtttgatccgcggcacccccttgccctgggcgtacatcagaccgaggtcggacatggcccctacatgacccagcgcggcggcgtcggagaagagttccgccgccttgttgtaatcctccttcttatacgccttgcatgcgtccttgaagatctgctcgttggggtctttcttggagccgaacataggtggcggaatgaggtggtggtatttcaaaggaagtatggcggctgagggatgcggcaacatcctttcttgtcagatgtccggacacttagagcgacgaatatctctatatcatgttgaaaacttggtttttgatattttcaactgataatcggtatctgttcgatcattcagtgcaagagtgccgaattcgcatatgatatcctcttgcaggcatttattggtccgagagtgcggaaccagtattaccagtggacgtcacctgaaatcggccatggtcggctgtccgcagcggaactccccgcacccgtttatcagcgaatccagcaggtatctgcatccgccgaggcccaccagactcctgtccatgaactctcctttcctcgcataaggcatggatatgcctatgcatgccacctccggatggagggtcttgtattcctccgccccgagtccgtccgtgaagacggccaccagacctctcccaccgaccttcctgccgagggccccggagcagtccgtctcctccaggaagcgcgatatcccagcatcgtagactgatcccctgcagtacgccttctccacggaggacggcaccatgccgaacaggccgtacatccactccatcagggggagcgtgtcggacggcatgcccttcagcgcacagcagagtcctctgaacgcacgggagtccttgtcgcagttgcggaggatgcggaacatcctctcctcctcggcgtccacggcctccagggcacggtcgggggaggtccccgtcgcatcggcgacatcctccaggaacgagcgtatcgccgggaaccctatgggtgcgcccttcctcgggaccaccgtcccgcatcctgcggaacggtagacctccgacgtctccgcggacatctccgggtggagcagtacgacggcctccgacatcccggaagacgagatctccgccttggacgatccgcaccctacgaaggaatccgtctcgacatccataagtgccagcagacgggatatgttctccttcccgtagttccagcagctgtcggcgagggagtatcccaggatgctgacgtgtcccttcctctccccttttccgaggcccgcgttccctaccagggcggacacggtcctgtcgaacccctccgccatggaaagggccgacaggtcgtcatcggagagcaccgtcctcccctcggtcccggaatccctcacggccttcccgcggtccgcgacctgcagggatgcaccgagggtgtctatcagcactatgtcctccgaggatgccgacgagacggagcggagaccgtcggtcatcttgttcccggatcccaggaccatgtcgtccgagttcagataggtgcaggggagatgggactgcctgctgaggtatttggagcggcagcagccgctctcctcccctccgtactctatggagagctccctccacaggttgagtgtcctggaacggcaccctccggggccgttgatcatggccttggcgccgcatccctcggccgccaggacggctccgaggaacccgtcgggtccgagtctcattcggaccccctcccgtaccagtcttcgcagggttttatgctcagacatctgacgaccttctcggcccagtcgagggccccctcccggccgatgtacatcgtggacgtcccgacccatctgtaaccggtgcgtcccgtgcgggcatcccccgatactatgaggtccacgcccagatcctccgctgcctcccggaggccgcagatgtccacgccctcgatcctgggtatcccggtgtatgtgctctcccttccgtcgtgttccacgaatttgttgtgccagtgggccacggccgccacctccatcccgaggtccgtcaggacgtctatgcgccagtcgaggtctgcatcggagcggacgtagaacaggaccttcctcccttcggccttcggcctcagggaagatatgacctcggaataggccttctcctccttttccaggaagacggatccggcctcgcggaggccggtcatttccgagaacgccgccacccactcgcgtacgcccctcatgccgcccatggactccaccagatggaccttcctcctcccggcgacggccttggccgccctgtcgttcatcggatgcctgtggacctgtaccaggtactgggacgaggggaccttgaggacgtcctccatcctcccgacgtcgactagcgccccgttcctccggaggccgaacgcggagaggagggagtccacgtactccctgttctccttcctgaccagatatcccggggtcatccccaggaacgacaccgttccgggtacctccggcatgtcccagtccatcatcctgcacagtgcggtcatcgcccccgagtagcacccgaacttgctggcgaggaacctgtcgtcctccgggactcctacgacctccgcaccgacgtccccgaggtcggctatgcatccgtctatgtcggccccgatgatctccgaggtgcaggtcgggaccacgaacacgtaacggaacccgtcctccaccgcctcggttatggcggccttgagggcctccctctcccccgcgaaggccttcctgccgtccagacccgacgagtagaggttgcatgtgcgcctgcgtccgccggagaagccctgccaatacgactccctcgtccatgcgtattcgtcaaggaacgcgcagttgtcggtcccgtgcatgaccacggcggcgtcctctatggccagcagggcctccgccgcaccgtgggaggtgcaggccggcatcacatagtcccccttgtacgtgatggcacgctcgctgtcgaaggagtcgaagctgcagtcggttcgtacggcgggagggtccttgtcggtgaccggctgtcctgccgcgatctgcatcatggccttgtccgagaggggcgaggcggagaggggctccaatcttcccgagaccgcgtcgcagaccatgtccgctatatgtgccagctgtttgtatgcgggactgtccgggaacagttctgagacggtcttcccggccccttccgccttggagaacaccgcgctgcgggagatctcccccagtatcctgacgcctgcggcctcggagaaggcctccacgcgggagcggtccccggggtccctgctgttgaggaccatccccaggacgcatcttccgccgttcaggttccttatgccgcggaggatgttgttggcggcgtagatggacatgaactcctccgaaacgaccaggatgatgccgtccacgttgtcccttctcatcggtacggagaatcctccgcacacgacgtcccccaggacgtcgcacacgcggacgtccgtgtcatcgggggtgttcctctccacataatccagcatggccgccatgcctttcccggcacacccgatgccgggttccgcccctccgcattcgacgcagtagatcccgttcgtcccggattcgatgacgtccccctcccctctgccggagaaggagtccatgaacgtcctctgggggacccctcccgtaaggagtctcgtggaatcgtgtttcggatcgcagccgacatgaaggaccttcatgccgcgttcggagaggatgtaggagaggttggatgaaatggaggatttcccgatacctcccttcccatagacggccaatttgtacattatgtgaagaatgacgtttattggatatataatccatctatgtctgacgtaacagcggaccgcgccttatgtcggcatccatggaaagggaccggtcacatcctccgtatggcctcgttcacttcctcggggtcctggagggggccgtctctatgcgggggatgtcgaagaagcagggtgcgaaaagcggcagatggagtatcccgtgtccgtccacacccacagggccgtctgcgatcttgatccccctctccaccttgtagtccccggaggtcagcatcagcagggatctggatatcttcgtttttccggatctcgtctctaatgcggtaagatgtcctttgtatgatatcacgaagtccattttcagcgaactgttcggtttgctgtagaagtggatcctgtagccgttggatacgagggcctgtgatatgcagctctccacgaccgcaccctcgttcacatacatggtatgattttgagaactccttcattatgaaggtcttcccggtctgacgcggtccctccaagaccaatgcccttccggaagatgatttccatttcagaagcgtatcatagaccttgcgatccgtgtatgtagggcatcatgtcccagactgtatattttactacaaaacaggacatcttcgagagggcctgtcatgaggtcagagtatccagcggatgtctcctctcaggtccctcagctggggcctgacggtcctggcgtgctcgacgacacctttgtccgcatacgttatgaggatttcctccccgttccccgccttggctatctcgtcgcccagaggactgtagagggcggagcctccgaagaactcggccccgtcgcggaacggtccgacgttgttgcaatagatcgtgtacacggtgttctccagggacctggccgggactatcctctccatggccgccttcgaactgtccgacgatgccgatatgacgatgaccatgtccgcgccctgggtggcgtagaagcggtggatctccgggaacatgacatcgtagcagatctcgagtccgatcctcatgcccttccattcgaccatggcggggctgtgtcccctttcgaacatgctctcgtcatagggagggaagttcgcggtgtacatcttgtcgtagcggtaggtctcgagaggtgttatgaaaagcatggagtcggtgatgccgttgtaccattgcatcggggcaccgaccgcgacggccacgtccatgttgttacagattatgcgcagcctgttctcggcgatcacggtgtcttccgggtcgaactccgagttcccgtatccggtcaggtacagttccgggaagacgtagaggtccgcctggttctgcattatggccccctctatgcgtttgaggttctcctccggatccgaggtgccggcgatctggcatattgcgatcctgatgcccatggaactatcagcgtgtattcgatattaaaacaatgcgcatttttccgcatccggggacattttttacacacctccatgtctggctatatccgtatccccagcaacctccggggaggccttgcatactgatgttttggaacaatattttaagaaataatgccattgactgggcatggccttcaaggagcttcacaagataacgcgtgcggacgcagactcccttactgcattcataaaggaatccgtggagaaggcgcatgccaaaggtgccgtcgtcggtatcagcggcggtgtcgactccgccgtcgtggcgaagctctgtgcggacgccctcggaggtgagaacgtgctgtgtgtgttcatgccgacggcggtcacacccggggaggattacgtccagacgaaagcgatgtgcaaaagctggaacatacgttacaaggccatcagcatccagtccgccgtggatgcgttctccggtatgctcctcaccgggaaggaggcgccgctcgagaagggcaacataatggcccggtgcaggatgatagtcctctacgacaaggcgaagaaggaggattatctcgtgatcggtaccaccaaccgttccgaacttctgatgggatacatgaccaagttcggcgacggggccgaggatgtcatgcccatgtacaacctttataagacccaggtatgggagatggcgaaggtcgtcggggtcccggacgagatcatagagaaggtccccaccgccggtctttgggaaggtcagaccgacgagtcggagatgggcataacctatctggatctggacaaggccttgaacgtcatggagcagggcggtagcgacgccgacatggcagccgccgccaatatctccgaggccaaggcgaaggaactcagggaccaggttggcaggatgatgcataagcattcccctgcgatgatccccggacagtaaggtcggaaaacaccccttcatccatccttcatatgtgccagatgttgtaattcgagtcatctgccggatatttatattttgaagacctttgatattcagaggtggacgataggtaacggtcccttgcgggaccggacccgtacgggtcagggttttatgcctcccctatgggaggcgtatcacgatcttgactctgcgagtcttgatcgtgacccggatgccgcatttcctgcgttcaatgaggatcattaagatcgtctcacctcctgccgggacggttccggtgcacgctgagagggtaagtctcggtgcaccggactccccgcctaacggcattccggacttactaggctcattggtaataaaaggctgatactacatgtagcacttgatgcctttccatgtgccagatactgaatatttggaacgtggatgtttatttatatcatgaaaaacctctgaatctcagaggtgaaatgggtaacggtcccttgtgggaccggaccctcgaggggtcagggttttacgtctccctcacgggaggcggatcacgatcttgaccctgttggtcttgatcgtgatctggataccgcctttacggcacttgatggtgatcatgaagatcgtctcacctcctgccgggacggttccggtgcacgctgagagggtaagtctcggtgcaccggactccccgcctaacggcattctgcatccactaggctcatcggtaataaaaggctgatattacatgcagtgctacatctacgtgtgtatcggatgtgccagacactgaatattctaaatgcggatgtttatttatatcatgaaaaacctctgaaactcagaggtggacgataagtaacggtcccttgcgggaccggacccgcatgggtcagggtttacgtctcccttacgggagacggatcacgatcttgactctgcgagtcttgattgttatccggaaaccatgtttccggcggtcaatgatgatcgcgaagatcgtctcacctcctgccgggacggttccggtgcacgttgagagggtcagtctcggtgcaccggactccccgcctaacggcattctgcatccactaggctcatttgtaataaaaggctgatattacatgtagccagtaagtcgttttaagatgtaatcgacctctgagaatgcagatagatatatgtcttggcggacccatcaccttttgataacgatgccatcgacagtcaatgtgaacatgcgtgtttgtgataagacttgcaggataaccgcaacccatcgcgaaggaggggacgatatcgagatgatatccaattgtaagcagctgcaggatatggcggcggccctcaaggacggagtaacctcggacgacatcctggacgtctacaacagccgtgttatgaaacctgaggtccgcggtacagtatgcctcgaatgtctggcggttcccgcgctgttcaacgtctgctggttggaggagggcatgatctccaagtccctcgccaggaagaacaagttcaattccgtcgatttcgacgagatctgaaaaagatcgccgcccccggcctgtatcggaggcggcttcccgtttatcttccaaacaccctctcggcttcggccgccatgacgtccgccatgtaggggtcctcccctacggcggaagcataccttatctccaccgccttcccgttcctgtggattatccctcctctggagttcttcctgaggcctatcttctgcgggatctcctccttcaggtgtaatccgcaggcgatgaacatcggcacgacgatgaccctgtcctcgctgacctccagcgccttatggaaagattcctctatcgtcggtccgcagaactcgttgtatcctacgaacaccttgtaccccttggatgcgacggccgtcgccacggattccaccgcctcggagttggacctgtcctcggagccgtggcccactatcaggatgcccgtcttctccgcatcccctccgttcgcctctatcgtcctcaggacgacgtccgccacccccggatcggatccgaccgccctgccgaatctgacggatatcctcctgccttcgacctccgcgacaccgtccccgtatccttcgaggcctatctccctcggaagatactccttggtgatggtcccgtcggctatgaagtaggggatgacgaggagttcgtccaccccgtcctccgccgccttcctcatcgcatcggctatcagtggctcgtcggcgcggtggaaggccgtgtagaccctctcgcccctcctggcggccaacctctccgcctgcttcctgaccgtatccgccgcatagggcatgctggacccgtatcctatgatcatgatagccttcatggtacaattatcgtcgtcaaacactttatagttggctgttatatccaatgccagaaatcgacttcggggttttccaatgggtgccataagggaggaacagggttttgtctacgtcggcgggaagaggctcaggagagggttcaccaccggttcgtgcgccgcggccgcgtccaaggccgccgtgcagatgctcctttccggttcccgtgtcgaatacgtcgacctcgtaacccctaaaggcataccgatacacgtcccggtggaggacatctcggtctccccctactccgtgtcgtgcgccgtccgtaaggacgggggcgacgacgcggacgacaccaacggcgcactggtctatgcgaaggtctcccggaaggcctccgaaggcatagatatcgacgggggcgtcggcgtcggaagggtcacccgcagaggtctcgaccagcccgtggggaacgccgccataaaccgtgtgccccgcagcatgataaaggaggcggtggaggacgtctgcggcacatacggccataccagggggatctcggtggagatctccgtccccgaaggggagaggatcgccgagaggacgttcaactcccgtctggggatcgtaggcgggatatccatcctcgggacgagcgggatagtggagcccatgagcgagaccgccctgctgggttccataaaggcggagatgaaggtgttcatggcccccgggaggaggtatctcctcaccgtccccgggaactacgggaaggacttcctcgcctcatatccggacctggaggggcagcagccggtggaatgcagcaatttcatcggggacttcctggacatggctgtcgaactgggcgccgaaggggtcctcctggtcggcaacctggggaagctggtcaaactggccggaggtataatgaacacccattcgcgcaacgcggactcgaggatggagatcctggcctccaacgccgtcatggccggggccgatgcggagaccgccaggcgggtcatggggtgcgtctccaccgacgacgcgttagaggtcctgtcggagaaggggctggtgggccccacgatggacgtcctgataccgaagatggagttccacatgaaccaccgtgtcaagggggccctcaaggtggccgccataacgttctcgtcggagttcggggtcctcggggagaccccttccgcgagggagcttttaaagaagatcgaggcaggggaatgaaggtagacataatcgcgttttccaccaaaggatgtcaaaaatcattggacatagcgggatgttttcccgaggacgaggtgaacctgttcgccaagaccaccgccgactccgtcggcatagagaaggtggagtgttccatgagggaatggacggagaggtccttcgcagagtgcgacgccatcgtcttcgtcggggcggtgggcatcgccgtgagggagatagcccccttcatcaggaacaagacggtggacccggccgtcatctcggtggacgagctgggaaggttctgcatccccatcctgtctgggcacataggcggagcgaacggcatagccgtcagggtggcgggacacataggcgcggtcccggtggtcaccaccgccaccgacataaacgggaagatagccatcgacgcatgggccgtgaacaacgacctttccatagtgaacctccatgcggccaaggacgtggcggccaggatcctctccggagacccggtcggattcgtgagcgacgtccccgtgaagggggacgtccccccggagctgtcggcggacgaggcctccacgggagtatatgtgggtaacggggatgcgaggccgttcgagacgaccctgaggctggtccccagggactgcgtcctggggataggatgccgcagggacacgcccgaggaggacatcgagggcatggtgtcccgtgccctggcggaggcgggaatctccatgaggaacgtgcgtgcggccgccagcatagacctgaagaaggacgaggcgggattgctggccttcgcatccaagcattccctgcccattacattctacacggcggacgagctcaacgcggtcccgggggagttctccaagtccgggttcgtgcagtcggtcaccgccgtcgactgcgtatgcgagaggtccgcggtaaaggcctcccgcggaggcaggataatactgaggaagtatgcgggggacggggtgaccgtcgccatagcccgcgaggacttctcggtggatttcacgaggtataggaaatgacccagaacgttctggttttcgcagggacgaccgagggaggggagatagcggacctcctcgcgcgttccggagtcaaggtgcatgcgtgtgtggccacggaatacggcaggacctctgtgaaggagcatgccaacgtggaggtgtcctcccgtcccctctcccccgaggagatgagggccctgatgaaggaatacccggtggtggtcgatgccacccatccgtatgccaccagcatatcgggccacgtgaaggaggcctgtgcggataccggggccgagtacatccgtctcgtacgtcccgcatccgagtgctacgagggcatgaaggtggtggacaccgtggacgaggcggtcgagtatctgaaagggaccgagggcaacatcctggccaccaccggcagcaaggaactggcgaaatacaccgcgatcccgggatacagggagagggtgttcgccagggtcctgtccctcgccaaggtcgtggaggcctgtgcggaactgggtttcgaaggcaggaacctgttcgccatgcagggccccttctgcgaggaggtggactacggcatgctcgtgcagaccggggccagatatctcgtaaccaaggattccggcgtcccgggagggttcgacgagaaggtcagggccgcccgcagggccggtgccgagatagtcctcgtgggaagaccggccgagcagccgggtaccgacttcgacgggacggtggagatcctctcggacagactgggcataggcctggaacgccggaagaggacgttgtccatcgtcggcaccggcgtgggcccgggtacgggcctcacctccgccggggcggcggccgtgagggcctccgacctggtggtcggggcggagaggatgctgcaggtgccggaagccgaagggaaggcatccctgtgcgagtacgcccctgacaagatattcgattatctggcacatcatccggaatacaggagggtgtccctcctggtgtccggcgacgtcggtttctacagcgccaccaggtccgtgttggcgaagacggacccgtccgagtacgatgtcgaactgcattgcgggatctcctccgtccagtatctgtgcgccagggccggcataccctggcaggacgtgaaactcgtcagtgcacacggtaagatggcgaacatcgtcggagaggcgaggaggaacggcgccgtgttcgccctcctcaacggcaggaccggcgtgaccgagatgtgccagcagctgatagattacaatatggacgtcacggtggccgtggggtgcgacctcggctatccggaggagaagtacttctacggcacccccgcggaggtcatgggttcggacctggggaacctctgcgccgccctcgtcttcaatcccagacccgacacccgctgccccataagcatccccgactcggagttcctgaggggcgacgcccccatgacgaaatcggagatcagggccctgtcggtggccaagatgaagctgtccgaggacagcatcgtctacgatgtgggcgcagggacgggatccgttaccgtcgagatggctctggtcgccgtggaggggacggtatatgcggtcgagaaggaggaggcggccgccgacctcatcgaccggaacaggaggaagttcggcacccccaacgtggagataatcagagggaaggcccccgacgcactcgcggaccttcccgcccccaccaacgtgttcatcggaggctcctccggcaacctcagggagatagtcgatgccgtcctggcgaagaacccccgctgcaggatagtcgtgaactccgtcaccctggagacgatatccgaggtgctggcacttccgtcgtcatgcaaggtggagcaggaggagatcgtctgtataaacgcatccaactccaggcgtctcggccgctacaacctgatgacggcccagaatccggtctacatcgccgtgttcagggggacgggcgaatgagcctcgcccgcttcatgatcgccgcccccgccagcgggagcgggaagaccaccgtcacctgcgggatcctccaggccctcgtcaacagggggatgaaggtctcgtccttcaagtgcggacccgactacatcgaccccatgttccatgcgagggtaataggcaccaagtccaggaacatggactcatacttctgcgacgacgagacgctgaggtacctcttctgccgcacggcggaggattcggacatctcggtcatcgagggggtcatgggattctacgacggtatccgtgccgccgacaccgtcggctcgtcctacgaggtgtcccagaagctggaggcgccggtggtcctgctggtgaactgcaaaggtgccagcatatccgtcgtccccgtcgtgaaagggttcaaggagtacagggagaaccgtatcgccggcgtgatcctcaacaacatgagcgcctccatattcccggaggtgaaggccgccgtcgagaaggagacgggggtcagggtcgtcggttacgtcccgaagctgaaggacctcgtcctggagagcaggcatctgggtctcgtcctccccgacgaggtcgcctccctcaaggagaacctgaaccgtctggcggggatcctggaggatacgttggacatcgacgccctggtggaactggccagcggggcccctccgatatccggtaaggccccggtgcacgggaccctcccggagaaggtcaggatcgggctcgcatacgacgacacgttctgcttcacctacgaggacaacatcgccctcctggaggagtgcggggcagagatcgtccccttctcacccatgagggatgcgagactccccgacgggatacacgggatcatcctctccggaggctatccggagctccacggggatgtcctaagcggcaacgcatccatgttggaggacatgagggagaagatctcgtccggcatgccgtgtctggcggaatgcggcgggttcatgtacctccacgagaggatggaggatgcggacggaaggatctggcccatggtcggggtcataaaaggcgaggtccgcaacacggggaagctgagccgcttcggctatgtcaccctctcgtcgcaggacggggactccatcctcgccgggggagggtgcaagggtcacgagttccattactgggacagttcggactgcggcacgtcgtgggaggcggtgaagacgtccgggaggaagtatgcctgcgggcacgaggaggggaacctcgcggcggggttcccgcacctctattactattccaatcccgatgtgccttacaggttcctcctcaaatgccgggactacgaggcgtgatcagatctccacgccgcccatgagcgacgccgatacgatctccacgatgacgacgaccgcgatgccgaccaggaagatccccatctgacggaggtccttctccttgtggtggaacgcctcgggcagcatgtcgcacatggtcacgaaggcgaatatgccgacggagaagcacagtgccagacctgcggtctccaggcctcctgtgtcgagggcgtagtaggatatcaccgccgcgaggggggatatgaggctgaacacggtcaggtacgtccacgtcttcttcctgtgatgggacatcagcatggtggacgccagggagaacacgacgaccgccttgtgcaggcacagggcgatgaggaccatcagacccacgtcgtccccggcgatgaacgccgccgcgagtgcgagtccgtcgaagaacgagtgtatggaaagccctatgaaggcggacatcgaggtgatgtcgtgttcgcaggcgtcgcatccctcgtactcgtccttcccgaagtacttcttcacgaggaagtccattatgaacagcaggaggaatcccgcgaatatcatgtaggccgcgttctcggcggaccctccgttgtccatcgccctctcgagcgcctccggcagcagcatgacgaacagcactccgagcatgatcccggtgctgaacgtgatgagcatgtggagcttgatcttcttgcctttcttgaagaggaagggaaggcgggccgcaatcatcgatacgacgaagatcgtcaccgcgaagacgatgagcatagcattgtcatccatgggtccgtcttgtcggtccgattattaaggtttattgggaatgttaataacattcggtcccggagaggaccgattttaataacatccctgcgaggtgttaataatcggggtatccgttccatcatccatgacagtcataagcgtgtccctgagcgaggagaacgtcgcggatctggacaggatacaggggacctacggcctcggaggacgctcggaggcggtccgtgccgccatagcgtccgccatgtccgagatacaggacatggagaacctggagggactcgtcgagggggtcctcataacgataaagagggaccacgccgacccgtggatgagcgtgatccaggcgaagcacacgggcgccataaagacgcagctgcattcgcacctcaagaaccacaaatgtctggaggtcatgatcatatcctgcgaggcctccgaactgcaggacatgctccgcgagatcgaggcggcgggtaaggccgattacatacgtttcgtcagcggatgaggctgttttcggcctacttaacacatattaaatccagccctcgcttatgattaaatatcaaaaacacatacctttagagcggatgggatggtagatgtggaaatcacactcggacagtggtaacgctcgtttttcgggtattatcgccaggatcaagtcgctcttcacgggcaggggcatcgtcgcagaagaaggccaacctcttgtggaggaatccaggagggcgcgcggactcgattgcaaccagttcgcgaaggtcgaggtcggggaaggcgccggcatatatgtgcagaaggtctccgacagcaggtatttcgacgagtccccggagtatgcccctgtgataaggccggtctacacagagtccttggacgatttcgagatccccgagcagcctgccggggaccgcgtatccttcagcgagcctgccgacatcttctccaatgcgaggaagaggcctacctacgagcccatcaacttcaacgagatcaagatcaaacagtccgtccctgcggcggagaccgtcgcagaggagtccgtccccgaggcccccaccggcctcatggagagggaggtccccgtcgtcgaggagacccccgcacccgtggcccccgccgccgagattgagttcatcgctcccgccgaggaggtccccgccgaggtacccgcatccgcggaggaacccgccgacatagggaccgacgacctgatggccgagctcgccatggccgagtattccgccctctcgttctacgaggcggtatccaaggtgagggagtccgaggcccgtgccgaggccgcgaaggagacggccgcccgtatggccgaggccgaagcctccgccgccgcagtggagaaggccgtcaggaccgtgcaggaggagaaggcggaagaactccccgcacccgtgctggcacttccgcagggaacgcccgtgtccatgatcggcgcccccgagaccgccgtggcggacaccgtcgtggtcgagtccgaggaggcccccgtcgtgcagatgacccttcccaagtcccggttctccgtggaggaactcgagagggaggccgccgaactggacgatgcgaactacgtgcccgggacctgcacacgccagacggccgagacctccgaggtcgcggaggcggtcgggaccgccgtacccgtcgagtatgtggagcctaacctgcgcagcgacgtgatcgaggtcgtggatgtcaacagggacgtcctctacgcataccgccccgccctcgccaacgacgaggagatgttcctcaccctgtcgagggacgacgacggcgaccttcccgaggacggcctcgagtcttacgacaggaagttcaaactcagagtaagcgacctggacaggtacgcgtaccatttctccggcaacctcaggcagctttggtgagccgttaatccccgctccttacggagcggggtccatcccttatccacacgggttggtgttatcccgttttctttataagccataatcatatcacgaactcatggaaatagtctcgatcctgctcatgctcctcgtgctgttcgtcctggcacgtatcgggaacaggatcttcgagcacttcggcatccccggactgatcggtgagatcctcgtaggtattctgatagcaaacatcgtcataggcggcgacactctcctggatttcctggatatcgagatcccggccccgggaagcgatcatgccggcaccaattattccgtcctgtatgcggctgccgagatcggagtgatattcctcctgttctcggtcggtctggagaccaaggtcaaggagctcctcggcgtcggaaagagcgcaatgctcgtcgccatcctcggtgtcgtcatcccgttcgtcctgggattcgcgtacatcgagttcactgactccaacttccatcacgccatgttcctcgcggccgccatggtggccaccagcgtcggtataaccgcccgtgtcatcaaggacatgcacctgatggacaagctggggtccaagatcatcatcggggccgcggtcatcgacgatgtcctgggtatgatcgtcctcgccatcgtcaagggtgtggcgggatccgacggcggcatgtccataatgggcgtggtacaggtgatcgtcgtggcctgcgtgttcgtcctggcggccatcctcttcgcgaagacggtcgtccccaagatatacgcatggaacgagaggagggtcaagaaggccagggacgagggcaagaccccttcgtccgtcaacatgctggcacttgcgctcatcgtctgtctgttcatgtcctggctggccgagagcatcggtctcgcggcgatcatcggcgccttcctggccggaatgatgttcgccgagcatgcctgggagtggaagctcgagcagaagttcgagacgataacctccgtgttcatctccttcttcttcatccatgtgggtatgcaggtcgacctcggggacctgggaagcacggccgtcatcatctccgccgtcgcggtcatagtcctcgccgtcctcggcaagtacatcggatgcgcgctcggggccaagataggcgacaagagcatctccaaggactcctgcaacatcatcggtatcggaatggtgcccagaggggaggtcggtatcatcgtggcctccatcggtctcaacaccatcgtggagggtgcacccgccctgtcgtcctccctgtatgctatcattgtcgtgatggcggtcgctacgaccataatcgccccgccgatactttccaagctgtacaggaagaagtatccgccggagtacaccataacggcgaacgacaagatctgagcagaagtgccagatcccggaaaaccccttactttcacttttccgtcggccggggaatcccggccgacacacatcttggatgatggcggtcggatccctggaaggggatgtgtcgatagacggggtcggatgccgacactctttacatggtaccttcgcaggatgtcggcatccctcggggcttcacatcgggtctgcagaaggatgtcgcacatattgcggatcccacgtccgggatgtcggcaaatctccgattgatgccgtcgttatgaaaaatccaagtcctgtatgccaggcgctcacatggggaagaatacggggagcacgagtatgaggacggtgaaagcgatggcggcggcgatgactaccttgggtccgatcttgatacccttgtcgtcctcggaatcgaagtacctcatcagtcctgcggacgaggagaatgattcgcctttgttctctttggccattgggcattcgtatattcggacaatatttaatcccattggtggaaggacgtataaaagccaacctttttattatcctcctataatgtgcgcgtccgattagtatgcactgggcagacgttatcgccaaggacattgccgagaaggccgagcacccgctcatagccaccggcatcagccctaccgggatcatccacgtagggagcctcagggaggcaatcaccggggaatctatacgcagtgcggtggaggggctcggcaaagacgtccgcctcatctacctcatcgattccttcgaccccctcaggaagaggtacgacttcctaccttccgagttcgagaaatatgtgggcatgccgataagcaggatcccctgcccctgcggcaagcacaggaactatgcgcaccacttcgtgcagccgttcctcgacgccgtggattccctcggagtccactgcgagatcatctggacgagcgacctctacaaggaggggaagttcgccgaggctatcgacatgaccttcaagaagaggaaggagatcatcgacatcctccacgaagtctccggaaaggaggccgaccccaactatgcgccgtacaaccccctctgcgagaagtgcggccgctacaccaagcctatcttcgactcctactccttcccgtacgtcgagtacgactgcccctgcgggcaccacgggaaggcggacataaggaaggacgacggtaagctgacctggaggctcgagtggcccgccaagtggaagatcttcggcacctccgcagagcccttcggaaaggaccacgccgccgccggagggtcctacgacaccggtaagaggttcgcgaaggagatcttcggcatcgagccgcccttcccgataccctacgagttcgtacagctgaagggtgtcggacagatgcacaagtccctcggatgcagcgtcaccggcctcgacgccatcaggatgacccctcccgaggtcctcaactacctgttcctcagggtccagccctccagggccatcgactacgattccgggctcggcaacctcgacatggccgacgaatacgacaggatggagaaggcgttcttcaccaaggagtacaccgaggtggaggagaactccgtccgtgcctacgagatcgcccagcacaaccacgtgcccaagcagatgcccgtacaggtctcctgcaggcacctctgcaacgtcgtgcagatcgccgacaccttcgaggaccagatgaacgtcctctccaggaccgtggacatctccaaggccaccgaggaggacatgaagaggatcaagaagcgctgcgagtgcatccagtattggctcaaggccttcgcccccgaccaggtcaagttctccatcagccagaccatccccgcgggagtggagctgaagatgaacgacaaggcgttcctgcagtccctggtcgccaggatgaacgactgcaactgggaccccgagactatcagcaacatcatctccgagtgcggcaaggcctcccccatagggctgaagaacgcctacaaggtgatctacaacctcatcatcggcaaatccgccggaccgaggctcggcaccttcctcgcctcgatggacaagcagttcgtcataaacaggttcaaccaggccgcctacaactgagcggcggggggggttccgaccccctctttctttatttttatgcatccgtgcgatttttattctcaagatgcacatctggcacatgggttttttaacaagattccatggacacgttagaagaggatccggatataagtctggcacatccgcccccgggcaccgccgggggcatttatgccgttatgatgtttttcagagcagaccgagctgcgacagtttttcgggcagatacgtgtccgtgacataatccaggccgtatttggccagcgcctgctgctcggccttcttgcccatgtcgagcatagcgtggatctcgctgtcccagaactcgtcgttgaacctcgggtcggtgagttccgcatgcagcgcccctatgtccttgtcgttgagcttgtcggtggggaggtcgtagttcaggatgtccgatgcggtgatcccgatgaactgggccgtgggggtcgccagatagtcggagatgtgggccgtcttgatggcaccgtacgccaccgacgcgaagatcctgaacgaccacgggtcgccgtcggtgaagacgaccacagggaggccgttctcctcgttgagcctctttatgagcctcctggtggacctggcgggctgaccggacaggtggacgaggcagcattcggccttctcgggaaagccgttctcgatgagcctcgcatacattcctcctgtctccagggccatgatgaattttacatcgtggcttttgatctcgaaggtctccttctcgacgctgtagggcacggcgaaaccctgctcggacacgtcgtccatgcagttgatgtccttcatccccttcttggtcatggtcctgaaggtgacgttgccgtacacgtgggccccgctctcctccggcctcagcttgaagtcctccctcatgcagtgggatatggtctccaggtcctccgccaggaggttgccttcgtcctgcgtgtggaacttggcggcgttccatccctcggagatgtagtacatctcccttagggtggacgatttgttctcacggatcatctcgttgatgaagtccgtggtgtaggcggtgcggagcatggtcgtcgccccctgggtcgtcttggccgtacgggtggtcttcagactcccgtatttccacacctgggtcatggggtcgaactctatgttcctcttggaacgcaggggaagggtcatctgcgggatgtcccctctgtcgagggcgtcgtatatcccctcggccacctccgtgaggcggtccatcgcgaccttctgtctgtcattcatcttccttcgcctccttctcgaactcctcttcctccagttcctccttctcctcttcctcggcggaatcgtcctccgggacgacgtcctccgtctccgttatctccataccctttatgccccagtccccgggcagcgcctccgcgcccatgactatcaccgggttgatcccggagacgtagacgtcgtcggggtcgaaggtgtcggccatgtcgccctccaggacgaacgagacctgcacggacttggagggttccaggtcccttacgacccactgggtcttcccctcgtcgttgacggagtcgaacatgggggagccggtgacggaatccgttatgctgtccttcggcagcgccatgtgcagcatgaaggtgtgcgggcggaccgtgtagttgtaaaccgtgtagtttatcgtataccccttcttgtcctcggtcctcttcttggacggttctatccagaccacgttcatgatcttcgtgatggtcctgctgaggtccgggaccggtctgcccagctgggtggagaccttgtccgccaggtccgggaggatcttctggacgatgtcgaacttctcgtgggtcttcgacttgcgctccatcttgttcagatgggacttcaggttcctggcgacgagcctcagggcggcgaggatctcctcctcgatctccggaagggaggctatggcctccttcccctcggaggtgaacggcaccttggtggaggccacgtggacgaggacgatggcgggtccgtaaggtatccccttccctcccctctgctccagaccgtatctcctccagtcgaactccgagacggccttggtgattatgtccgcaccctgctggtatagcagggggacgcggttggcgaacctcatgatggtgacctgaccgtcggagggtatctccccgccgtatacgatcccggcctcgacggtgaaagggttcccgttgaccgcatgggcgggtctcgtgacgggggtggcgtagtattcggggcgcatcccgtccaggatgtgcatgaggcccttcttgatcaggacgtcccctatgggggagaggcagtcggacggaggagccatgatcttcgtgtccgcgatggcggagatgagcttcatgctgccctccctccccaggtcctggggtctggacttcgggtccaccccggccttcccgcagacctcggaggcgagcctgtccgtcatccggcagaagtcgttcttcaggaaatccttcaccgtcttctgcgaggattgggcggagtagcccatcatgtccccgatctccatgccggcgggatggggtttgatctccgccgccttgggcggcatggtctccgtggccctctcgaaggtccaggtcttcccgtccgggtcgtggaacttgatacgggcgtgcggattgacgatggccgtctccttcagatactcgaagatggactgcttcccggtcacgtagcgtcccttggtggtgtattctatgagcgtaccgtgggccttgtccatccaggggaaggccctgtcgttggtgactatggggcggttggtcttggtgtcgacggcgatgtccatctcccacgcgacctcctcctccccctcgatcctcgaggcgatgtgggccggtttcccggtggacacgttggcgtacatgacggtggcggatatcccgataccctgctgtcctctggattgacgcatggcatggaacctcgacccgtacagaagacgcccgaagacgttgggcatggcgcggtggacgatcccgggaccgttgtcctcgatggacaccgtgtactcctcctcgcccaccttcgtgaccttgaccacgatgtccgggaggatctccgcctcctcgcaggcgtcgagcgagttgtcgaccgcctccttcacgcccatcaggagcgatttggcgcgggagtcgaacccgaggatctgtttgttcttctcgaaaaactccgtgaccgatatctcgtgctgcttgtcggcgagctgttcggccgtagccctgccgctcctggccgcccttaccggcggctctgagtcttttcccatcggggaaagggaatggggtggagggttttattactatggttcagcgcttcccgacggccttcccctcagacccggaacgggactgtgccagatacagcgctccgacggatatgaggaccagtccgaagaggtacatgaaccagtcccagacgtagtcctccagaagggccaggaccacggcggcggccacgaggccgacgcccgtcgtcttctccgcggcgacgcttccgaagttcacgtttatcacggggaggggcatcatgaagaacagcttcagacccagttcggcgaccacgatcacggccagccagaagatcaggaaaccggggccgtccgtcacgtagaggacgaatcccatcaccgcgagcatgcacccgccgaagatcatgtccctcggaccgtcggtcctcgcacccttgtatatcaggtagatcccgccgatgaggacgaggatccccacggcgttgaagaagtccctgtccgagacgaattttccggccctgaccactatcgctatgacgcccagcgccaccagtacgacggccagaagaggccccgtcaccgcattgtccttcccttccatgtctgtcacctatcggatgtcaaagtctgcccatcatgtcgagtgcttttatcagatgcaggacgccggctatcatcacgagtatcccgccgatgaccatcaccgcatccgccatgccggccaggtcggcggcgagtaccacccctacggccacgaggaccagtccccagacctggttcctcctgcgggtacccctgtcgaggttgaacccgaggaacctcttggtgccgcacatcatgaggacacctgccaacgccaccccggcccccaggatcagggcccctccgaccagggcggcgagggatatcaggacgatgcctgcgatcagcgcgacggtgccggcgcgcgtgatgtcggaataggatatgaaatcggcgaccccgaaaacgatcaggagggccccgccgatctctatgacgaggttcacggagtccgtcccgcacactgccatgatgatgccgaatatgatgaaaagtatccctatcagcatcatgttggcccatgagcgtcctgcgaaacgctccagattgaggtcgctccttccgatcatcttctccagccgtatgggtgccgaggcactataaaaaggataagcggattgtatcgtttcttttctttttgtctatacggttatcatgtcgtatccatacttgtagtacgttccgacaccgggtactgaatcgtacatccgatactgacggtgggtttcgacggatgtcgattatgggatatgccagcatcggtatgggtcggtcggatgcagatgtatgcccctcggacggtcgatatgtatgggtcaagtcacaagatccatcgtctggctatatcggatgatacgtcgtcttcgacatcccgatacatgcatattccgatgtatggctatgtcgttctcctccagagaacatacggatgcccgatgaatgcagtccgttggtcttttttccgtcctgacgatacaataaatcgaggcactgagggaatagtattcatatctgataatgtaataatccaactatgtcattccttgacaacactaagactgcaggaacggcactgtggatcgtcggaatcctgatgatcatctctgccctccttaccatcatctgcggagtcgtagatgacgagatgaacgaccacgtcatcggatgggtcatcctcggaatcggatccctcatctgtgcgttggtgtactttgcattcggaaagagcgttaagtccggagaagtctccgacaagttcgacatcgtcaccaagttcgtgtacgtcgtcggatacaccaccatcatcggcggagtcttcgccgccctctgcggattcggcttcgacgacatcggcggatacctcgtcagcggtatcatcagcatcgtcctcggattcgtcatcctctggatccacaagaagatcaccgatggaaacatcagcaccttcgacaggatcatgtggatcctcctcctcgtgatcttcgtcatctgcttcatctcctccttcttcggaatcggaggaagcggacttgcactcgctgtcaacatcatcgttgcgatctgcgacatcgtcatctacctgttcatgatcgcattcatgctcgacaacagcgtcaaggcaaagttcgggatgtgagtaaggtaaaactttaaataaggcccgaaggggcccctccgggggcctctgggtcttcaatattttcctacgatgctcttgtatcgattcgatttgcgatcccctattcgtggggattcatgtgtgtttaaatttatgacaggtttcatggcggaatattccgacccctgccgatgtgccgatcgtcctatcatggattgggacggattcggtatcgttgtcgatttggaccttgagaagttcttcgataccttgaaccaggattttcttatgaacatcctgagagagcgtatcaaggataaggctctgatagagctaatcaagaggttcctcagaagcggagtggtgcttcctgacggtctccgtcaggagacccgtcagggttcaccgcagggcggacctctgtccccgcttctttccaatatctatcttgacagattcgacaggcttctcgagagcagaggactgcgcttctgcagatatgcggacgatcgccttatctttgtaaggactcccaaagcaggtgaacgggtgagggaatccgtcacacgttaccttgaaagtgacctgaaactgaaggtgaatcaggagaagaccgtagtaggcggagccgacacggtcaagttcctgggcttcaaattatttcgaaataaggctgtacacgtgaacatacacccctcttccctggaatcattcagaaaggcggtcagagaaaagaccaaacgcaactgcaatgggagtctcgtatctatactggacgagctgaaggcctatgtacgcggttggttcggataattctccattggtctttccaaatcccgcagggaggaactgaacggatggatgaggagacgtataagacagtacattttcaaacaatgaaagacatctcggaacagggcaagacagcttatcaaactgtgtcctgaattcctgaaaccccatccagaatatattccggatgaatggcggtcttcatgctataaagccgcctataaccgcagttactgaacggtctctggttattctgtcgtgagatacagattatccaacaaggtcctgaaagacctgggcatgtatttcattcaaggaaatgtagagaaatggtttgaaaccgccgagtaccgaccggtacgctcggtggtgtgagaggtccggttgggcaatagcccaaccgtcctactcgatttcagaacttcttcccgcacttgggacagaagacggcgttcttcgggaccatctccccgcacttggggcagggatatgattcctcgctcacgtccactttcccgtcgatgtgggagacgacgttctccacgccatcgaacttcgcgccgcacttggggcagacctgtgcgtcccccggtacctccgcaccgcatgcggagcactggaagaagtcgtccttcttcctcctcatctcctcgggacggtcgatgtatgcgccgcacttcctgcacttgatctctcccgggaggaccaatgcgccgcacttgtcgcatctcccgtatccctgggggtacaggcgtccgtcgttctccatcttctttctcttgccgctgatggtccttctgaggagcgtcgagaacacgaggatcaggaagaatatgaacaggacgtagagcatgacgacggcggccccggtgtagcactgcgaactgcatccggccccggtgaacccggtgagggtggcgatggaggcggaattcccgtcatacaccacgtcgccgttctcgtcggtctttccgatcgccaggaccaggttgtacagctcggacatgtcgaagtccgatcccgtcagcgtgtactgcagatggctgccggagatgtgggtgctgtccaacggtatgttcttgagaccctctatctgcggagagctgttgaacggtaccagggtgaccttcgcatagcacaggtagattgtgtccccgtcgtatccggtcatgtcgaagtccgcatccacggttatcgtcctcgcggagtcgtcgtacacatagccgacgtcgctgaaggccccgtggtccgagaccgactccctgctgttgttgtccacgaaggaaggtcccaccacggccccgcccaccactatggccacgactgcgaatatcagggcgaaccctgccttcgccttcggtttgacaccgaagaagtgcggtatcatgtatatgaccacggcgacgatgagccagcctatggcggaacctccgaatcctcctacgcagaggacggcgatgccgatgacggcggcagcgcacatcgcgatgatctgcatcactgtaacggagcggaagaccgtcttggagaagacggaactgcccgcgttgttggaatccatggggtgcgctatcttatcgccttttaaataaatagtggctcggaagaagaggacgtatccgtatgcgggtgcggtttcatcttctctgacatcctggacaccagcaggtgctgcgtcccccgaccgtatccctcacgaacgtcttcccgcatctgggacatgggtccccttcgtggccgtaggccctgaggtatccgacgtcgtagtatctcctgcccctgccctccaggtactcctccctgctcacggcgttcttccctatggcgaaggagatgatgtccggtatgacatgtgccagatcctcgaattgaccgtcggtgaggtctctgcagggggtcagcgggcatatccccgccttgaagagcatctcgtccgaccagatgttgccgatgccggcgaccaccgtctggtcgaggagcccctccttgacggtgatacccctacttcccagcctgtccttcagatatccggcgtccagtccggggtcgtccggttcgagtcccagaccgcggatcccggaggtgtcctcctcgtccctgcggaagtgccagatgtgtccgaagcgccgggggtcgacatacctcagctccatcccgtcgtccaggaggaacacctcgtgggtgtgtctctcctccgcggtatccgggggacagacgtacagctgtcccgtcatcccgaagcggataaccgtgtgtcctctcaggtcgtcgtagagcaggagcgccttccccctccttccgaccgatacgacggtcctcccggtcaggcgctccgatagacccggagggtccgtgttggcgagtatcctgttgtccgcggccctgacggacacgaaggtcctgccctcaacctgtggtccgacgaccctcctcaccgtctctatctccggaagctctggcataatgatacggaatcccgtcatagattaaaacatgacaactccttaatagtgggtgcataatcatcagttcctaaggaggcgtaccgatggctacaatcgaggagcagatcgaggagttggagaaggagatcgccaacaccaagaagaacaaggctacagaggcgcacatcggtaagctgaaggccaagatcgccaagctcgccatggagaaggagaagaggctcgagacgatcaaggccggcggcgggtccaagggattctatgtgaagaaggcgggtaacgccacggtcgcactcgtcggattcccgtccgtgggaaagtccaccctcctgaaccagctgaccggggcccattcagaggtcggtgcctaccacttcaccaccctggacgtcgtgcccggcgtgatggagtacaaccatgcgaagatccagatcctggatatgcccggtctcatcaaggacgcttccagaggtaaggggaggggaagggaggtcatcgccgccgcgaggtccgctgacatcatcctgctggtcgtggacatcttcaaccccgacctgagggtcctcctgaaggagctctacaactccgccatcaggctcaaccagcatgcgcccgacgtgaacatcaccaccgcgcagcagggcggtataatagtcaagcccaccctcaagctcaccaagatcaccgtggacaccatcaaggacatggtggccgcctacgggcacatcaacgccaccgtcgtcgtccgcgaggacatagacgtcgagcagatgctggacgtcctggccgggaaccgcgtctacataaaggcggtcatggccatcaacaaggtcgacctggcgaagcccggacagctcgaggccgtgcaggagatgcacaggcagtacaagagcgtcggcgtctccgccgccaccggttacaacatggacgccctcaagcaggagatctacgaccagatcgacatgatccgcatatatctcaagccccaggggcaggaggcggacatgaaggagcccctcatcgtcaaaaggggtaactccgtcggggatgtctgcgaactcatccacagggacttcaagaacgccttcagatacgccatggtctgggggaagagcgccaagttccccggtcagaccgtgggtatggaccacatcgtcgaggacgaggacatcctctgcatcatcgtgaagaggtcctgatcaaagggcgaatttcttcttcacggtctccagcatcccttcgaacgtggaggtctccgctatggtgtcgcagggcatgccggctttcgacatggattccgccgtgggtctccctatggccaccttgaacgtcttcctcagggcctcgtccgtcctgtccttcccgaacctgtcggtcatctgaccgtagaacaccaggaacgagttgggactggtcatcagcagggcgtccagagtgccggactcggtcttctccaggagttcctccgtatcctcgcatatctgcgccggcaccatgtcgtatacaggttcgtcgaggaccttggcgtgcgccttctccaggatgtccactatcttcccgtcgcctccggccgacctcaggaggacgaccgtcttgtaggcgacctcgtcggctatctcctcggccacgccgacgccggagtagacctccggtacgaggtcggtgtccctccccgtgagtctcttgaggaccttctcggtgctgctgccggtgcaggccacgttggtcttctccagaagtgccagcagcttctccttcccgtattcgtcgacgcactcctccacggcggtgatggatgcgaagagggtgaagtacgcctccccggaggagaggacctcctctatctcgtcgaagacctccttgtcccccctgacggggtcgaaggagggggctccgaagggctcgaagcccatctcggagcagatcctctcgccctcggcgatcctgtccctcggacgtgtgaacccgaccgatatcatgccaggtcacccaggaccgctctgagctggaccacggtgccgatgaccattatgccgggggtggcgacgttctcctccctgatggtcctctcgaggtcccccaccgtggtcacgtagaccttctggtcgggggtggatcccttggacaggatggccgcgggcatgtcgggggacatcccgccctccacgaggccggcggatatgttgccggcgttctcgagtcccatcaggatcacgagggtcccgtgtccgccgaccaggctcttccagtcgatgcggtcctcggacctgtcgcccttctcgtggccggttatgaaggtcaccatggaggcatggtccctgtgggtcacggggatgccgcagagctccgggacggatatggccgaggtcactccggggatgacatgcacttccacgcccgccttcctgagcttctcggcctcctcggccccccttccgaagaggaacgggtcccctcccttgagccttgccacgaccttccccttctgtgcgtactccaccaggaggtcgttggtctgccactgtctgagatggtggtcggccgccctcttcccggcgtcgatgagttcggcaccctctttgcattccttcaggagttcggggctggaaagggcgtcgtacatgacgacgtctgcctcgcggagggcctgcagccctttgacggtgatcagtccggtgtctccgggcccggcacctatgagatatacttttccggtcatctgggtcatgccttcttcagaagtctgtccgcgatctccttggccttcgcatcggcttcggacgcggggaattcggtgactatcctgacgggtattatgtcggcgaaggacacggctatgagcttcatcgtgtccccgaccagctcggcgttgatgccgatgggggaggagcacccggcgttcatgtgcctgagtatgtccctctcgagcttcacctcggcacgggtcttggcatcgtccaccttcttcaggagttcgatggtcttcgtgtcgtcggccctgcactcgatgccgatggccccctgtccggccgccgggacgaacacgtgcttgtcgatggggtgcacatccctctcgatgccgagcctgtcgaggccggccttggccatgattatggcgttgtactccccttcctggagtttctccaggcgggtgttcatgtttccgcggagggtcttcaccctcagggacggcttggtcgccctgagcatcatctccctcctcacgctggaggtcccgatgatggcgccgcactgcagctgctcgagggaggccgggatgagggcgtccctgacgtcggccctggggaggacggcggccacgacgaacctggggtccagctgggcggggatgtccttgagggagttgacggtgcagtcgatctccccgttcaggagggcctcctccagctccttgacgaagaccccggtcccgcccatgtcggcgagatgggtctttatgtccttgtccccggtcgaggtcatgccctttatctcgcaggcctcccccgtcgtcttctcgaggagcgctttgaactcctcggcctgtgccatagccagctggctctctctgcttccggcgatcatttcttcacctgtttaaggaatccttcgaaggtcttcgcgatcttctcgcaggcctcttcgtcgtgcgccgccgacatgaactcgacctccatgggtccgggcggcaggtagaccccatggtgcagcatgtaatcgaacatctcggcgaacatgtccctgtccgccttctgggcgtcgctcccgttcgtgacctcgtcgacgccgaagtatatggagaacatggaggcgatggactgtatgcatccccgcaccccgctgtcctcgagggcgtccctcatgcgggccacgagcgtctgggtctttttctccaggctgtcgtatctgcccttctcggccatgatgtctatggtctccagacccgcggcggcggagaccgggttgcctgcgaaggtgccggccgcgtagaccggtccgttgggggccaccatctccatgatctccctcttccccatgaacgccccggcggggtatccccctccgatgatcttgcccatggtagtgaggtcgggggtgacgccgaagcgcccctgggcgctcccggcggagagtctgaacccggtgatgacctcgtcgaagatgaggagggccccgtgctccttcgtgatcttcctcatttcggccagatatcccttcttaggggtcaccaccccgacgtttcccatgacgggctccattatgatgcccgcgatgtcctcgttcctgtcgaggagcgattcgaacatgccggcgtcgttgtattcgaccaggtaggtgttcctcacgtcgtcctccggtaccccgagggagctcggggtcccgttcacggatcccgaaccggccgccacgaggacggtgttgtgggccccgtggaaccctccgttgagcttgacgatgccgttcttcttcgtgtatcccctggccagtctgacggcgtgcatggtggcctccgtaccggagacggccatcctgcacatctccgccgagggcacggtggacgtgatcttctccagaagtttggtctcgggatgggacggggcgccgaagacggagcccttcttggtctggtccctgacggccttcgcgacgcggggacaggagtgtcccacgatgaggggcccgtaggccatgcagaggtccacgtagtcgttgccgtctatgtcggtgatcctgcatccctgaccgctgtcgatgacgagcgggaagggcttgaacgctctgacaggggaggagacgcccccgggggtgatcctcctgagctgaccagcctcggattctgagttggacagtctcaattcactcccctctcaggaccttggcggcgtctttcgcgtaataggtgatgatcatgtccgccccggccctcttgatgccgatgagggactccatcatgatccttttctcgtctatccatccgttccttgcggccgccttgatcatggcgtactcgccggacacctggtatgcgcagatgggtacggggaacgagtccgcggcctccctcactatatccagatagggtccggccggtttcaccatgatgatgtctgcaccttcgtcgaggtcggatgcgatctccctgagggcctcgcgcctgttggccgggtccatctggtacgtggccctgtccttcctggcgtggcactggcaggagggggccgagttggcgatgtccctgaaaggcccgtagtaggcgctctggtacttcgccgagtaggccatgatgggggtgttctcgaacccctccatgtcgagggcggtcctgatggcgtcgatctgcccgtccatcatcccgctgggtgcgatgatgtccgccccggccctcgcctgggatacggcgatcttcccgtagagttcgatggtggggtcgttgtccacatccccgtcgtccctcaggacgccgcagtggccgtggtcggtgtattcgcacatgcacaggtctgcgatgacgaccagctcctcgccgtccttcagggcgcctttgagacccctgatggcctgttggacgaccccgtcgtcggaatatgcgtcggaaccgacggaatccttcttcttcgggacgccgaacaccaggacggaggacactccgctgtccaggatgtccttcgttatggattcgtatccggagagcggatacgtggggacgccgggcatggagtcggtgtacttcacctcgtctatgttggcgtcgaagaatacggggaggatgagctccgaggggtcgagccgggtctcgcggaccagcgacctgatctccggtgtctgtctaagccttctccctctgtttataggaaacatctctctcactccttctccttatcgttatgttcttttatcaggccgaacagcctcgccgccgcctcgacggtctcggaatccccgtccagggcggcccttctgagattctttatgaattccgcgcttatcatcttgactatcgcatgggacatgtcgtcgatgaccttgtcggggtcgtctccgttgcccagataggacttggccatggcggcctcctcgctccttatcctctcgcacatgatgctgaactcgcggatggtgatgttggcgtccctcgccttgcgctcgtcctcgatcttctgcatctcctgccggattatcctctcggcggcgcttatctcccctttcctcttggccacgttctccgccgctatggcgtccagggcggccatggtggagagtttgacattgggtatctccaccacgtccttggcgatgttggtgggcaccgatacgtcaatcatgaggaggggccggtcgggcctttcggccatggccctctccacgttctccttggtcacgacgtcgtgtttcgcagaggtggccacgaggacgaggtcgctcctggcgatcattccgtccagacggtccagggtcacggcggtcccgccgagctccttggccagctcctgcgccctctcgaacgtcctgttggagacgaacaccgtctccggaccttttcccacgaggttcttggcgatgacccccgccatgtccccggcccctatgatggctatgttcttaccgtcgagggatcctatctccttctcggccagttctatggcggcgtatccgaccgataccgcccctttgttgagttcggtctcggtcctcaccctcttccctacgatgatggcgttgttgaacaacgcatagagggatttgcccacatgcccctccttctgggccttcatgaacgcgtcgcgggtctgatgctggatctggtcctctccgacgatcagggagtctatgccgcagacgaccgtgaaaagatgctttatgcactcgttgtcctgcagtatgtaccagaactccctgtccgaataaggtatggtcttcttgacaatcctctccatcatcaggcgtacgtcgtggttgtcgtcggtggccacataggcctccagacggttgcacgtacgtattatgacatattcttccacgtctttcgattcagcaagcgcctttcctactgcatcctctattccaggtatgatgtcgttcaggcattccataccgccggcagaggaatgggttatgtgcagacttaccaacatgaggggaccccgcataccggaggaccatccggtgttacgattatacgttaacagtaatattgctggactatatagcctgttcgtccgtctggatcctttcttccatacctcggacgtccagacggtcatattcgtatttggccgtcattcccgtcgcacacggggatgaccgagacatgtgccattccttataacatcacatgtgccagatggtaaactgtccgatccaagatgcttatttatatcatgaaaaacctccgatatttagaggtgaaatgggtaacggtcccttgcgggaccggacccgcatgggtcagggtttacgtctcccttacgggagacggatcacgatcttgactctacgagtcttgatcgttatccggaaaccatgtttccggcgttctatggtgaacgagaacacacattcacctcctgccgggacggttccggtgcacgttgagagggaggtctcggtgcaccggactccccgcctaacggcattctgcatccactaggctcatcggtaataaaaggctgatattacatgcagtgctacatctacgtgtgtatcggatgtgccagacactgaatattctaaatgtggatgtttatttatatcatgaaaaacctctgaaactcagaggtggacgataagtaacggtcccttgcgggaccggacccgcatgggtcagggtttacgtctcccttacgggagacggatcacgatcttgactctgcgagtcttgatcgttatccggaaaccatgtttccggcggtcaatgatgatcgcgaagatcgtctcacctcctgccgggacggttccggtgcacgttgagagggtcagtctcggtgcaccggactccccgcctaacggcattctgcatccactaggctcatttgtaataaaaggctgatattacatgcagtgctacatccgcagtgttcatcggatgtgccagcaacatctggccgatgtggctccgagtctttctcagacgaaccgtctccccgctccgaccggtatccgtcccaccttccccggtcaacttccgagacgcaattaatttaatacagcccgactgtcggtagtggtatgatacagtgtccccgtggaacgagggatttcctgcccgacgagcttgagaagagaaggtcctacgagaatgttctcagaggagtagctcatagattcgggttcagggagatcgagaccccgatcttcgaggatgcggaactcttcatcctcaggtccggccccggggtcatgaaggagctctacaacttcaaagacaagggagacagggatatcgccctccgcccggagatgacggcctcagtcataagggcgttcgtgaacggcatggggagttaccccaaacccatcaaggtgttctacttcggccagtgcttcaggtacgaaaggcctcaggccggcagatacagggagttcttccagttcggtgccgagataatcggctcggccacccccgagaccgatgccgaggcgatagccatggcggcatcgatgatcaaatccctcgggctcaggaactataagatccgcatcggtcacataggcgtcctgaggcagaggatcgccgacatcggtgttcccaaggagaggaccgcggaggtccttcagaaactcgacaagaaattgtacgacgaggcgagaccgatcctcagggatatcggagtgaaggacgaggatgcggaagccctcttcgaccttaccgagacggtaggcggcgtcgaggtcctcgataaagtccccggagaggcgggtgcctatctcaaggagctcgtggacatactcggtgtcatgggggtcagggacctggagatcgacctcggggtcgtcaggggtctcgattactatacaggcatggtcttcgaggcggaagcgccggtcctcggagccgagaagcagatctgcggcggcggatcctacaccctctccgagctcttcggcggcgagaaggtcttctccaccggtttcgccatcgggttcgacaggatcctgttggccatggagaaggagggcatcgtatacgaggagaagggcatcgacgcctatgtcatccccgtctccgaggatgtcaggaaagacgccgcagggatcgtatcccgtctccgtgccgagggcaggagcgccgacatagacatcatgggaaggaagatggccaaggccctgaagtatgccgactccatacgtgccagatatgccgtgatagtcggaaggaaggagctcgagaacggctgcgtgaccctcagggacatgaagaccggggaccagaaggaggtccccgtcgacaacatattccaggatgcgtgagcgtcggtacttccgacatctggcacatgggcttttccccatgtgccttatttttttaccagggtgtgttccccctgtagggcggtctcccgaccatccctcttcttctcgataataatatatggaaaggcgggatagcatgcccaacgcctgttgtatgggcgggaagggaaaacccaaatgaaagcattattcagtgacggaagcgtgaaggaagtcgaagacggtctctctgttctgagacacacaacctcccatgtcctcgcgcaggccgtgaagagactgtacccggagacgaagctcgccatcgggccctcgatagcagacggattctactacgacatggacagggaagggggattcaccgacgccgacctcgagaagatcgaggccgagatgaagaagatcgtgaaggagaacctcaagctcgagacattcaccctgtcccgtgccgacgccatcaaattgatggaggagaagaacgaggactacaaggtacagctgatcaaggacctcccggaggatgccgtcatcagtttctacaaacagggggagttcaccgacctctgtgcgggaccgcacgtcctctacacgaaacagtgcaaggcgttcaaactcacctccctcgccggtgcgtactggaggggtgacgagcacaacaagatgctcacccgtatctacggtaccgccttcgagagcaaggaggacctcgagaaatacctcgtcatgctggaggaggccaagaagagggaccacaggagactcggcaaggagctcggcatattcatgttctccgaagagggacccggattcccgttcttcctccccaacgggatgaccctcaagaacatcctcctgaactactggagggagatacacttccccgagggatacaaggagatctccaccccgctcatcctcaacaagcacctgtgggagatgtccggccactgggaccattacaaggacaacatgtacaccacgaccatcgacgacgagccctactgcatcaagccgatgaactgtcccggcagcaccatcgtgttcgccagcgagtcccgttcctacagggaccttccgctgaggctcggcgagttcggtatcgtccacaggcacgagaggtccggtaccctgcatggtctgttcagggtccgctgcttcacccaggacgattcccatctttacgtgacccccgagcagatcgagtcggagatcaccaacgtcgtccgtatcatcgacaaggtgtacaagcagttcggattcaagtaccatgtcgagctctccacccgtcccgaggacagcatgggcagcgacgaggactgggagaacgccaccaacggtctggtccatgcgctcgaggccatcggactcccctatgtcgtcaacgagggggacggggcgttctacgggcccaagatcgacttccatctggaggactccatcggaaggacctggcagtgcgggaccatccagctcgacttccagatgccccagaggttcaatctggagtatgtcggtgcggacggggagaagcaccatcccgtcatgatccaccgtgtcgtgttcggttctgtcgagaggttcatgggtatcctcatcgagcactatgcgggaaggttccccgtatggctcgcacccgtgcaggtgaaggtgctgtcggtctccgagaagagcagggaatatgccgccaaggtgacctcccagctgatggccgccggtatccgcgtcgagaacgatgcgagggacgagaagatcggatacaagatccgcgaggcacagctgcagagggtcccgtacatgctcgtcatcggtgagaaggagagcgaggacggtaccgtcgtcgccgtgaggagcagggacaagggagacctcggttcctgtaagaccgaggagttcatcgccacggtcctcaagcagaacgccgataagcaggattgagggggaaggggccccggaaggggcctccgacctctctttacatgattttagaaaatttatttttacattaattgagaagttctttgggaccgatcaggagtatgccttccttctcggccgttttgacgaggtccccgtcgaatcccgagacggagaacatggcgagcctcttgtcgtccgcttccaccgcttcggcccttttcttcagattcttcagcgcccctgtgtcgatcttcccttttctgaacttacagtcgcatacgagggtgtattcggacccgtccttttctatcacggccgcgaggttgatgctgttcgtggactcgccggcgatccaccatccccccaccgccttgcagtcgaagttctccttgagatagccgtaacatatgctgcggaacctcagttccaggaacatgccggcctccggagcgatgtcggagaaatccgtccggtccgccaggactatgtcggagttgttccttatcaccgtatggtagaatcccagcaaggggttctttaccgtgaatacgggtttcttcggtgcattggctatcgggttcacacgggctatcatgccttcggattccatcttcttcagatatacctcgcagagctgacgggatatcccctggtcgttggcgaggtcgatgggacgtccgcatcccttggccatctcggacaggatcgcggaacagtacctgtaggggacggaggacttcctgactatgttctccgcttcggtacacaggcggggataggtcccgaggaagcatttctcgacgcaggtctcgtagtccgacttgttcataaggagatggtacaaggggatgcctccgacggtaaggtggcacttgtaggcgtccaggtccttcatcttgccgtgcagttccctggattctgcgaaggagaggggtctgaggaccacggcgtcctttatgcggtctttcaaaggggagcgctcggtcatggataccatggcattctccggcgatccgcaaaggatcagcatgttgtcggagtcccttatgtggccgtctatgaatctgccgagggccttcctgaactccagggagtcggcgttggcggcatcgtctagcactacgaccgtcccatccccgccgcaggcggcccctatcgcagagaacgcctcgtcgtaatccgcgggcagggggatgtcttccgaggtgtatctcgtgacggaatcgcatatggattcgagcatttcgcgcagggtcccttccgggaagcggacgatgatggccggttttcccttgcagaactcccttaccagtcccgatgtccccgtgcgggacctcccgtatacggagcatgtgcggaggccgtccgccgaatacagcctctccaaggcctccagctctttttccctgcctgcgaattgtgccatgtgggatatatccatcgtttgtcaattaatacttaacatcttgcaacggtattttctggcatcataacatacccggtcaggggtctatggcggccttcactccctctgcgaatctgtcggcgtcgaggtcctcgagcttgaaatatctggcccccatcttctccgccagcatccgggcgttgtcgaagtgggggaatcccatcccggcatccaccacgatccacttgaccccggggatcttcatgtcctcggccatcttctgcacctcatcgttggcgtccgcaccctctctgagggggacgttggcccttccgtcggtgacaaggatgacgaagcacctctccccgacatggcatctcgcataggcggtcatgtactcgtccacccttacgagggcttccgacaggggcgtcttaccgcccgtagggagttcctccagacacttgtagctgtattccacggatttggtcggagggaggatcatgtcggcggagtcgcggcggaacgccatgagtcctatccggtcccttttgacataactgtccctgagcatggacaggatggcacctttgacggtcgccatcctcttcctcacacccagcgacccgctggcatccaccaggaacagcagggtgcatccgctgcgtctctcgcgcaccttctcccttatgtcctgtttctcgatgacgagggctacatcgtcgctgtgtcttaccctctgatatggggcggccgcccttatggtggcgtcgaacgctatgtcctccgtccttccgtcgggtatcctcgagcgtgcatatctcccggtcccgtcggcgctgacggccatggccctgcgtcccttgcgtgtcttcgtccgggaggggaccctgtcgcgcgtatcgagataatctatcacgcggaactgcctgccgatctcgaacatcatctcctcgaggtcgggcatgtcctgcatgggcggttccggaggcttctcttcttcttcgtcctcatgttcctcctccggggggtcccttctttcgtcggggtcgtcgcggggagggtcctgcctgtcctcctcctcatcgtccggaggctcttccggaggttcctcgggaggttcggggggctgcgggggcggaggaggctggtcgtagttcctcctgtggggcaggcacaggacggcggcctcttcgacatccttcctcatgacctcgtcgcgtccgttgagcgccgcgagggattcggcgcattccaccatggcgatgtcccctctgaccccgtcggctccgactttgacacacagttcggatatgacggatacgagttcgtcggaaatggtcacgagagggaggatcttggatgccctccccaccttcaccctctcttcctcctcgtccttcccgtacaggtccatgaaacggctggggtcgtcgcagaactccgcgttacgggtcaggatggtgtgtctctgttccgcatcgcattcggaggcgtaggcgcacaggtcgaatctgtcgagcatgtgggcgctgaggtcgctgtcttcgggattcatcgtggccacgagggtcgtgtcgcaccggtatacggcggatacgggccctctctccacatggaccgtcccggtgaggacggcgtcgaggactccggcgagcatgccgcggtccatcaggttgacgtcgtctatgtagagtatgttcccgtcggccctggcaaggaggccgggctggagtgcgggcctccccgtcttcatggcctcctcgatgtccattccgccgaacagctgctcgtcggttacgttcagggggcagttgacgaccttcctgtcggtgatccccgcggccgcacgggccagcacggtcttcgccgtcccgcctcctccgcggaggagcaccgtgcggatgttcggattcacgagggcgcattcgagggccctcttggcgtcgtccatcccgactacggcggtgaacggaagggagttcacaggtcctgcaggcatttctcgagctcctcttggtcgagacccgcctcttcgaacggacgcctcttcaggcggtgggcgaggaccagttccgcggtcgcacggatgtcgtccttcgtgaccttcttacggccttcgagggccgcattggccttggcggccttcaggagggttatgtccgccctgtgtccgtccactccgaaatggatcatgacggagacgaccatgtccaccacgtcgtcccctgcgacgacctccggcaggatcctcctcgcctcggtcagccttctgcaggtctcgtcgagctcctccttgcattctttgatgtatgattccgggtcggagtcgtatctgacccttctcttgacgacctccgccctcttcttgacgtccctctcccccttgatgtccagggagagtccgaacctgtccaggagctggggcctgaggtccccctcctccgggttcatggtgcccacgagcacgaacttcgcggggtgggagaacgagacgccttccctctcgacgtagttggtccccatggcggcggaatccagaagaaggtccaccaggtggtcgtccaggaggttgacctcgtcgacatagagtatgtttccgttggcggaagcgaggacccccggctcgaacttcttctcgccggtcttgaggacgtgctccagatccaatgtcccggagaccctgtcctcggtggcggacagagggaggtcgatgaccctcatcctgctctcggcgggctccagttcctcccccttcgagaccctgttcctgcaataggggcagtacctctcctcctttccgaactcgcagcggaaggggcatcctttcaccacggtcctgtagggaaggacggcgttcatcgacctcacggtcgtggacttggccgtccccttctcccctttgatgaggacgccgccgatcccgggatcgatgacgttcagcatcagggcgcgtttcatattctcttgacctactattctggtgaatgggaaaacgaggggttcttccgtcatattgtcagccctatatcacttggatgattactccaatagacaatctcctttaattccttttgccatgcgggagacggggattccagtgaacggtggaaaagagatcgacagcaagaaggtctacatggccgcattggcggtgtatgtcgtattcttcatcgcattcgtcgccgggtacatcatgctgaaggacggcgactcccttgcggcgggcatgtccgctttcgcactcctgttcctcatgatatcggcgggattcgcatactacatcctcgtctaccttcccaagaggagggagcccgaggatgtctccgacgaggcatgggagaagaggtgaagacggagggtctggaaattggatatatactccaatttactatactcccccgataccgatgtccgaaaggtccgagaaacgccggaagaagctgacggtcgccgcagctctgatctatatcgcatttttggccgtggccatagccgtgtacgtcttcctgaaggactccgactccttggtcatggcgttgtatttcgtcagcagcaccctgaccctcgtcaccataatcttcgcggtgttggtaatgaggtcctcgccttcggaggagtattacgagaagtacatgaaggaaagggaggaagaggaaaggggcaggtgaccgcatcgtcggataccgtcgaccgtccattcccggtcctggaccttcggcgatgagatccgccatttccgatcggacatcatctgtcggttatctcctctatcctttcctcggtcttgatgaagaggtcctttatcttctcacggtactcgtcgtccgccttccacagtccgcgttctatggcctcctgaaggcggttgaggatgttcatcatcgcatacgggttgacgtcctgcatccattcctgcgtatccttgtcgaagaggaacttgtccgccagcccttcgtacatccaatcctccgccacgtccgaggtggccccccaggccatggtgtattcggtaaggttggccatctcggccgcccctctgtacccgtgttccttgagtccgttgatgaacttggggttgaggaccttggagcggaaggtgaagcggagctcgtccttcgtgtcgcggatcttggtcctcttggggtccgagccgtcgcccatgaacgtcatggcgtccttcctcccgtaggcccggacgaatgcgttcatgcctcccagatactcgtatacgtcgtcgcagtccaggaggtcgatctccctgtccggcatgttcttgaccgtgaccccgaccttggagaatctcctcacgaactcgtcccgcatcttctgaccgtagttgcctttctcgtagccgttgctgcaccagtcgatgtagacgtcggccaggtcctggacggtcttccacgacccagcctctatggccttgttgacgcctgtgccgtatcctccgggcggggcgccgaatatgcggacggagttcctccggcgggcctcgtcgggcgtcagtccttcggcgataccttcgacgatgtccttcctgaggttggccgcgagggcgttgtcctcgtccccctcgtccagcgatgccacgagtttcacggcgtcgtctatcatatctattaggttggggaaggtgtccctgaaaagaccggttatgttgacggagacgtccactctgggtcttttgagttccgacagcgggacgacctccaggtccacgacctgtccccccgccttggaccataccggtctgacccctaggagccacagtatgtaggcgacgtcgtcacctccggtcttcatggtgtcggtggcccaaattatgaaacccacctcccgggggaactcccccttctcggcggtgtatttctctatcatctggtcggccatcttcctgcctatctcccaagccgccttgctggggaccgtgtctggatctagcgagtagtagttccttcccatcgggagtatgtcggcattccctcttgtaggggcgccggagggtccgggaaggacgtagcctccctccattccatgcatgatgttctctatctcgtcggacatcctgcggacgttggggaccaccgtctggcacatgtattccacggatgtacggaggtcttccgacaccctgccgtgggcctcctctatcttcttaagacaggcggggacgtcgtatccggtccccctcgcccaggcgaggaagtcctggagttcggcgtccaccctgtccaccgcctcgctgttcagttccccggagggaaggcttcccgcggggtcgccgatcgccttctggatatccacgccctcgttctctgcgaaggcgtccctcagactgcggacccctccgttgtccaatctcatgagggagtagacagtctcgtcgaaatgggtgtccttcgggacgcgtcccaggatgtgcaggtccgacctcacgagggcgtccttgacctccgagaggtattcgtgcaggggcactatgtaggggaggaagccctccggtccggggtcgttctcctcggtgatcccgaggtcgttgagcatcttgtgtccttttgcggcctcgtagacctcccgtaccagtacggatacgcgctctgcgtcgggggagttcttctgcttgaagtactcctgcaggggtacctccacctcctctatctcctcgtactgtccggcccgtgccatggacgggggcatgtgtccgatcaggacgctctcgatcctcctcttgcactgggtcccctcccccgggtcgtcgacgatgtaaggatatatgttggggagacctcccaggaccacgtcgggatcgcacttctgggacatgcccacgttcttccccggcagccattctatggtcccgtgggtgcccacatggatcaccatgtccgccttgaaggagtcccttatccacctgtaatatgccagatattggtgttgggcgaagagggtcgggtcgtggatgtcctgctccatcttctccgccgtccctctcagcggttggtatccgatgaagacgtttcccttcaggatcccggggatgacgacgtccctgccgtcgacgcatatctctccggggggatccccccagtccttcctcatcatctcctggtcccattcgggtattttgcggaagtccttctcataatccttctccggtacgagggcgacggccttctccctcatggtccccgaggacatgctgtcgaggtcgttggtgaccccgtccaggatctcttccaccagctgtcttccgttctccgggacgttgtccacggtgtatccgcattcggacatccgtctcaggaggtcggatatgctctccaccgagtcgaggccggcggcgttgccgatgacgccggaattgggacgggactgccacaggagtatggcgaccctcctctccgatgccggtatgtatctcaacttggcccagttgtaggcgaggtccaccagcctctctatcctgtcggggatggggacggccttcttcataccgcttttcttcggcgtgtaggcgatggggacggttatgatgtccccgtctatctccgggaatgccacggaggaggagatctcgtgtttgttgagaccgatcttgtcctgctcgaaatccgcataatccccggtgatgctcatgctgtgcagcatggggacgtcgaggagggtgtgatagtagttgtcggcatcggagatcctcacccccatgtcgtcacgggagttgtacatcacggagaaggacgtatggacgatgaccacgtccgggatggccttccccttgtccgtgaagtaggtctcgaaggtctccttggtcccgggttcgccgtcccttttgtaggaggtggcggaatagaacacggggagggcgttcatcccccttctctcgatggcctcgacgagggcgtccacggcctccaggttgtcgtatatccacaggctgctggcgaacaggatgcccacggtcatcttctccggatcgagggtcttcaggtagtcgtcgcgggagatgtccctgtccatgcccttgtggtaatatccctcgcgcctctgctccaccggttcgggcggatcggcatcggaaagacccagacggtgggcgaaccacttcatcatcccgaggtcgttctcgggtccgcgtgatgcggcgtagcgggatacctgtgcgaactcctcgtcggaccctttgaagagggccctcttcatcatcgtgacctcggcgttcccgctgaagatgaggacgtatcctttgcattcctccaggaccttctcatacttgtcgtacctcttgaaacggttggtgtcggacatgcagcgcagataaacgaggtccgcgaggcgggtacgcctcaccagttcctggtagactaggatgtcgtcgtccgcatcgtccgagtttatggcatatacgtcgggttctattccgagttccctgagtttttcggcgggtccggccatggtcttggcgtccgccgtctggagcgatagtatgacgatgcgcatctgcatattatgttggatatataatccaataattaaaatatcgtgttggaactatattccaaccgatagtcatgctaaggatcgcaggtattggaatcggcagcaaggacggacacatactggcaccggcggtggccgcgctgtcggaggaatacgacatcgatctgatatgcggcgacgccgtcgccctggacggggacctggagcgtctcggggaatttctggacgaggtccgcacctgtgatttcatgctgatatgcgtccacggcgacgtgtcctatttccgccacttccgtgagttggaggagacgctggaacattcggattgctccgccctgctcgtttgttccgaaccggagaccaccgcggagtaccgccgtctcttcagacagggggacgacgacttcctgaccctcaggaagttggaggaggccggcggcgacgataaccagaaggccgtggtcctatgggccctgaagaccttcgccggggccgatgtggaggtcccggaaccggtcatgcctccggcccaggggatatacgtgccgggggagggatacgtccctctggaggaaggcatcggcaaggtcgggaggaagggattgccggtcatagccgtgttcttccaccagaagtatttcctcgtccacaacaccgccatggtggacgagctctgccacgacatagaggagaggggggccgaggcggtggcgatattcatgatctcgtcggtcagggacctggtgggttccataggtatccgcggcatagtggacggatatctgataagggacgggaggcccgtggtcgactgcgtcgtcaacaccatgggtttcgcccagaccctcctcgcagacccaggtaacgggacgcaggtatgcggggacaacttcttcgagaggctcgatgtgccggtgatccaggccgtcaccctctacggggacccgaagaagtgggaggagagtccgttcggtctcacgtccgcggacatagccatgagcgtggtgaatcccgagtacgacgggcagatagacaccgtaccggtctgcggcgccgtcgtctgtcccgacggggcctacaggaccatgccgatcccggagaggtgccgcatggtggccgacaccgccttcagatgggcatcgctccgctatgtgccagaagataaaaagaaggtcgcggtcctcatatacatgtatcctccgaggcaggaccttgcgggaggagggtacggtctcgataccctccagagcgtctccgacatgctccaccgcatgaaggagcacggatacagtctggaatggcttcccaaggacgggaaggaactcgtcacccgcctcctcgacggggtcaccaacgacgatggctggaagtccgacgtccagatacgcgaggccgcggtggacacggtccctgccgaaagatacgaggaatggttccgggagatagcggaaagcgcacagaggaggatggtcgaaggatggggcgaccctccgggggacatccacgtgctggacgggagacagctcctgccgggcataatggacggcaacgtcttcatagggttccagccggacagggggaagaccacgtcccaggcataccacgacgcctggacggccccgccccaccagtatctgggattctacaggtggctgcgtgacgtctggaaggccgatgccgtcgtacatgtcggtacccacgggacgctcgaatggcttcccggcaagagcgcgggtctttccggcgaatgcgatccggacataatcctgggaaacatccccaacgtcaatccgtacatcatagacaatccgggggaggggatgcaggccaagaggaggagttacgccgtcataaccacgcatatgatcccggccatggtccgctccggcgggtacgacgcgatcaacgaactggagaacgccgtacaggtcttcctcaaggccaaggagtacgaccagagggataagatcccgtctatagcggagaaggtcatggacatatgtaccagactgaacatattggatgaggcgggactgtcgaaggactcctccctggaggagatagaggagagggtggatgctctctacgactatgttcttgagatcaaggacgccatgataaaagacggcctccacatactgggggaggtcccggaaggcaagaggatggcggagacggtgtacaccctcgtcagatacgccaacggagacgtcccctccctgagggagtcgatagcagatatccacggctgggacatggaggaccttctgaaggacccgtcgggggtccttcccgacgggctgctcaaaggggaggcgtccgataccgtggacggcgaatcattccgcctcatcgaggcgatgcaggcggaggatttctctcccggggaatgtctggcactttctaaggggatgttctgcggaggcagtcccgatctggagaaggtggtgtcgttcgtctgcggggacctgataggggccctgcgccgcatgggggacgagataggcaacgtccttctggccctcgacgggaggttcgtcccgcccggtccctccggctgtcccaacagggggagggcgcagatcctccccacggggaggaacttctattccatagacccggacgggatcccgtggcattccagctgggagataggctccaagatggcggagcagatggtggaacgttacgtgaaggacaacgggacgtatccgaggaccgtggggatcgtcctctgggccaccgataccatgaagaccgggggcgacgacgtctcctacatcctccggctgatgggtctccgtccggtatgggcggactacggaggcagggtgaaggacctggaggtcatcccgctctccgaattgaaaagacccaggatcgacgtgacgctgaggatcagcggtctgttcagggacaccttccccaatctggtggagatgatagaccgcggcgtccagaccatatcttccctggacgaggacgacgagtcgaactatctggcggccgacctcaggagggacgtcgtggaggccatagcctccggggtcccggcggacgaggcccgcagggccgcatccgtacgtatattcggcgacgcccccggccagtacggatgcgggataagcgacgtcatcgagaccggggcctgggagacggtcggggatctggccgaggtctacgtgaagcatgggtgctatgtctacggcaagggtctccagggggaggctagacccgacctgttcaggaagaggctcggggagatggacgtgaccgtcaagaaccacaactccagggcggtcgacatgttggacatggacgacgacatggattccctcggaggattcaacgcggccgtggaggggatcagggggaagaaaccggtgtcctacatgggcgattcgtccgacatgcagaacctgaggctgaggaccgcaggcgaggagatccggttcgtataccgcagcaaggtggacaacccgaaatggctggacggtctgaagaagcacggtttcgccggtgcgaaggaactatccaaactgttcgatttcacattggggtggtcgggcacgtccgacatagtggacgactggatgtacgacgacctcgccgaacgtttcatcctcgacgaagagacccgcgagtggataaaggacgagaacccctatgcgatggtggacatgctgaggagactggacgaggccatggaaagaggtctctgggatgccaccgacgagatgaaggagaagctgaaggacatctatctggagttcgaggagaggatagaggagataacggacagatgatcctcccgacgtcgttcatctttcgcaagtattgtggagacgatatcgggatcgcgaccttccgttgcgtatcgccgatacgtcttctatgatgtgccagcatcccatattcagatcgtagtcttctggggatcccgtcgaagaccggatgccctacatatcgcaaccgcaagaggtctcgtccgtttcccatctttgcggcatatcccttatgctggcatttcgtagaagaagtgccgaccgcaccgatggcggtcggaggatccatttgggaaaaggtccgcccttccgggcggctttatcgttttcagatcttcctgttctttatcagatacaggtcgatcagatagaatgccagcgcgaacagtgccagcactcccagtgcccagtacgggaacgcatacacgtccagtgccgcggccctgatgcagacgctcgcctccgtcagggggagggcgtaaaggagtccctggaggacctcgggcagtgcggccaccgagaagaaggtaccgcagaggaaggtcataggggtgatcacgaggctgctgaacgtcgacatggcctgatgggacttcaccatcagggcggccgtctccccgaggagggagaacgtgaagcacgccaggaggacggacaccaccaggagcggggtcagattcatgtacgagggttcgagcacgtatccgattatgaacatcaggctgcagctgagcagactcctgcacattcccagggcggtcttcccgatgattatggccgaattgctgagagggcacatcatcatctcgtcgaagcttctgtaatacagcctctggacgttcatcctggtggatgtggacgagaaggaggacgacagggacgtcagggcgatgatacccgggatgacgaagtcgaggtacgggatcatctgtccctcgatctccacatcccccgctttgagaccgtaaccgaatgccaggagatacagtatgggcagcatcaggctcgagatgaggatgttgcggacgttgtgcctcatgaaacggatgtcggaccacgccacggcgtagacctctgtgaggaaagacaatcacatccctcccatcttcttcatgccggatccgcccttcccggactgtcccagcatgaatccgttgtctccgatcttgttcccggtcatctccacgaaggcatcctcgagattggtcctcctgacggtgaccgtgtacgtctcgtccaatgtcttggcgaatccgtccgcctccgccctcgtctggaagtatttgtactgggtcttgtggtcgggtccgaagtactcgacggtggccgcacctatcctgtgtgcgagttcctcgggagtcccttcggcgatgatcttccctttctctatgaaactgaccctgttgcacagagattcggcctcctctatgtagtgggtggttaggaatatggtcatcccgtcgtcgttgagtttcctcaggaggtcccagaggccccttctggcctggatgtcgagacccaccgtgggctcgtccaggaaaagcagtttggggctgtggaccagggcgcatacgatggcgaccctcttcttccatccgccggaaaggctatcgaccttgtaattgtagtactcccccagtccgatgtactcggacagctggtcgatcctcttcctgcggtcctccttaggcatctgttggtagagggcatgggacatcatgttctcccagaccgtgaggtccttgtccagggagatgtgctgctggatgacgccgatggcggccttggcctccctcggctcctccacgatgttgtgcccgtctatgacgacggaaccctcgtcgaacccggtaagggtgcttaagaccctcacggtggtggtcttccctgctccgttggggcccaggaaggcatacatctcccctctcttcactctcatgttaacgccgtcgatggctgatttgtcaccgtagcgtttgacaagaccgtctaccgcgattatgtagtcgtcttccgttaaatcacgtccttatatctgaattggatgatacatccatagtataaatcagtacttgaatgaaggcggttccatatcgttctgggcctttgccgtcacaataacaaattaataacccgtctgcgttctagtcttaattggatattatatccaactcaaaaaccgagggtcggaaatgcagatcaagatcgacggcctggagttcggatactccagcacaccagtactgaacgatatcaccttggacctctccggtcccaaattcgtctccatcatggggcccaacggggtggggaaatcaactcttatacattgtataaacaagattctgacccccacttccggtaccgtcatgctcgacggcaaggacgtcaaggagatcaccatcaaggatatggccaagcaggtcggatacgttccgtattccgccaacgacacattccccctcaccgtcgtggacaccgtgctcatggggaggcatccccacagcaagtggaagtccctcgacaacgacctcgatatcgtgtacgacacactgaagatgctcgggatatcccatctcgctatgaggaacttcaacgagctctccgccggacagcatcagaaggtcatgctggccaggggtctggtccaggagccgaaggtcctccttctcgacgagccgacctcgaacctcgatgtgagacatcagctggatgtgaccaagatgctgaagaagctctcggtcgagaaaggcatactgataatcatgataagccatgacatcaatatcgccgccaagttctccgacgaggtgatcatgatgcatcaggggcacatatacgatgtcggtaccccggaccatgtcataaacgaggagaacctcaaggtggtctacggtgtggagtccaagatcgtggacgacgacggcagacctcatgtgatactcaaagacgccattccgatggacgagtcggccgatatggtcgaacgcgtcaggtcgcccgtgatggcggccgccatcaggaagaagcaggaagaggccaaaagactcgtcgagaaagagacgtccgaggcctgaaaacatattcgatataggtagtgtgaaaaatgaaaggaaaactctacggcataggcgtaggtccgggcgatccgggcctcatgacgatcagggcgaaggagctcctcgacggtgcgcaggtcatcgcatacccggtcaagaaaccgggggaggacggtaccgccctcgagatcatcaagcagaaggtggacatctccgggaaggaggtcgtcgaactcctgttcagcatgaatcccgacgacgaggtccgcaagagatgccgtgccgagaacatcgacaggatctgcggaatgctcgaccagggcaaggacatcgccatgatcacgctcggcgacgtcgccgtatacagcacatacatgtacctcgaccgggaggtcagggacaggggatatgagaccgaggtcgtccccgggatcccctcgttctgccacggggccgcgaaggccgggcttcccctgatgatcggcgaggagagtctcgcagtcctatccatggccaaacatgacatcgggaaggtggagaaggccgtggattgcatcgacaacatcgtcattatgaaggcgttcgcatccatccgcgagatcgccgacatgatggggcgcaagggcatccccctatccaatgcgaccgtcatgagcaacatcggaatggaagacgaatacgtcggtcctctggagaccgacaggaaatatggttacttcacgaccgtccttatcaaaaagaaggtgaactgaatggagatggtgcatttcatcggagcgggtcccggagaccccgaactcataactatcaaaggaaagaggctgatcgaccaggcggacgtgatcatattcgccggatccctcgtgaaccccgccgtcctggacggcaggaagaaggacgccgtcgtgtacgacagcgcatacatgaacctcgacgaggtcatggacgtcgtcatccctgcggtcaaggcgggcaagaaggtcgtccgcgtccacaccggggacccctccatatacggggcgataagggagcagatggtcaggctggacgccgagggcatagagtacgacgtcatccccggcgtatcctcgttctgtgcttccgccgccgccgtaaaaaaagaatttacacttcccagcgtctcgcagaccgtcatcatcaccaggatggagggcagaacccccgtcccccgaaggagaagctgaaggacctcgccgcccaccatgcatccatgtgcatcttcctgagcgtcgggttcatggacgagctgaccaagaccctcatggaggccggatacgagcccgactgccccatggccgtcgtctacaaggccagctggcccgagcagaagatcctctacggcaccgtggagaccatggcgaagctggtcaaggaaaacaagatcgagaagaccgccatgaccatggtgggaggattcctgggcgacgagttcgagctctcgaagctctatgacagtcatttcaccaccggataccgcaaggggaccgattgagatggcaggcagactgacagtggtcggattcggtccgggcgggaaggaggacatgaccctccgtgccgtgcacgccatagaatccgccgacatagtcacgggatacacgacctatgtgaagctcctccaggagttcttcccggacaaggagtacaaggccaccgggatgatgaaggaggtcgacaggtgcaggatggccatcgaggacaccctttccgggaagaacgtcgccatggtcagctccggcgattccgggatatatgggatgaccggactcatctacgagctggcggacgagatgggcgcggacatagagatagagtccgtggccggtgtcacggccgcctcctccagtgccgccatcctcggtgcacccctcatgcacgataccgcactcatcagcctctccgacctgatgacccccatagagagcatcatgaagagggtcgattgcgccggtcagtccgatttcgtgatcgcattatacaatcccaagagccacggcaggacagagtacctcggtcaggcgacggacatccttctgaagtaccgcagtccggagacccccgtagggatcgtgagacaggccgggaggaaggaccagagcaagaccgtcaccaccctcgggaagctgaaggaggccgatgtggacatgttctgcaccgtggtcatcggaaattcccggacctatgtgaaggacggggtcatgatcactcccagaggatacagggagaccaaacgcttttgatggatataaggagtgagagaaatggttttcgagatactgacgccccgcgagatcgaggccaagagcatggagacgataaccaaggagctcggcggccgcacctggcccgaacccgagttctccatagtgaagagatgcatacacacttcggcggatttcgattatgcggacaatctctgtttctccgaagatgccgcgaagatcggcgtggaggccctgaagaacggtgcggacatagtgaccgacaccaagatggcggccgcaggcataaacaagaacaagctcacctcgctgggaggggaggtccactgctacatcagcgacccggatgtggtcgaggaggccaagtccaggggatgcacccgttccaccgtctgtatggagaggggggccaaactgggtaaaccgaccatcttcgtgatcggcaacgcccccaccgccctcatcgaactccacaggctcataaacgaggagggtctcaggcccgcactcatagtgggtgtccctgtcggtttcgtcaacgtcgtggagtccaaggagctcatcatgaccgacgacatgccctacatcgtcgccaaaggcaggaagggcggaagcaacatcggcgccgccatcataaacgccatgctgtacaccatgggcaggtaatcgtttttcacccgggggcttcggccccctcatcccggtggtaatgtgccagattatgtgatagatgcagagggcattgtcgtcagattcggtgatttcacagcggtcgaccatatggacgtccatgtggcggaaggggagatctacggattcctggggcccaacggggcagggaagaccaccacggtgaagatactgaccaccatgatgaagcccgccgagggaagtatctcggtcggagggtaccgtacggacacccatgcggacgaggcccgccgtctgatcggggtggtccagcagcacatcgccttggacaaggacatctccgtcagggagaacataatctgccgcgccatgctccacaagatacccaggaaggatatcggcccccgtatggaggagctctgcgacatgatcggcctgacaccgtatctggacaagacccccatggagctctccggcggatggaagaggaagaccgccatagtgtgcgccctcatgcacaggccgaaggtcctcttcctcgacgaacccaccgcaggtctcgacacccagtcgaggcacatgctctgggatatgatccgcatcatgaacaggaacggcaccaccatcttcctcaccacccactacatggacgaggccgagtccctgtgcgacagggtgagcataatcggccacgggaagatcagggacagcggcacccccagggagctgtgctgccgtctgggtaagtacaccgtggaatacgattccgacgacgggaggcgccaatacaggttcttcgacaccagggaggaggccaaggccttcttcgacacggtggaggacaggaacggggtcgtcagggggacgcatctggaggatgtgttcctggaggagaccggcaggacgaacgtgaaggctttggagaaggcgctgaggatatgaacaacgttctcgacgacatatatcgtgtggccctttcggacctgtactatctgaaaaggaatgtctgggtattgttggccacatcattggtgacgccccttctttacctcgtggcgttcggctacgggctcgggaagggggtgaccatggagggcgtggactacatagcgttcgtgatcccgggggtcatagcgctcacgaccctgtcttcttccttcaccacgatatccaacaaactgatggtccagaagaggttctacgagagcttcgacgagatgatgctgtgtcccgtgtccaagacgggtataatcttcggcaaggccgtgctgggtatggccaagggcatgatgtgcggcaccatattgctgatactgggtcttttcatgagcgacgacctgcatgtgaccgtggggctgatattgtgcatggtcctctcgtgcgtagtgttctcccttctgggggtggccgcggggatgctggtcaaggaccttccccacatgaatctgttcaacagcttcgtcatccttccgatgacgttcctgtgcgggactatgttctctctgaatgccctgccggacgtcgccaaatgggtcatcgagatccttcctctgactcatacgtcggaatgtatcagggccgccgccctggactggtccttcccctggatctcgttggcggtactgctggtgtacggggcggcgttctacctgctgtcgctgtatgctctgaggcagagcaattgagttggattgattattggattatagaccaccgatgcggactccacacaggtgggggatatcgtcggccgatgatcccgtccgccatatccatggcgggattgagacgggggaggcccgatccccgtcataggatttccgtcaagaggtcttcttttccttcttttttttggccatgcgggattccgggactgggatcccgagggcctcgagtttctccttggcgtcagagttccctttggatgcggccttcagatacatctccctggcacattcgggatcgtccttctccacgatggtggcgtatctgtacagtgctttggagtactcggcctcggcggacagccgcaggaatgtcatgcctctctcggtgtcatttttctcgtcgaggtagatctccgccagatggtatatcgcacgcggactgttcgattccctgaaccatctctcggcctcatccagatccctctccgttcccttgccgtacagatagaactcgcccagattcgtcatccccctggtacatccgccctgtgccgatctcagataccatccgaaggccttgtcgcggtcctgcgggactccgttcccgaagtcgtacatgaccccgatgttacacatggcgcgggcgtttcccgcctcggcggattccgtgtaccatctggcaccttcctccttgtccctctccacattgatccctacggcatagcagtaaccaagattcctcattccggaactgtctccgagggccgcggccttacggaatagtttgatcgactccttcctttcggtctcgtccccctgtgaatagacgtctcccaacaggactatcgaagatgtacagttcttcaggacgttcttctgcagcagttctatcgcctgcggatcgtgcccgtcctccttcagaagttcgtatgctttcgagaatctggcacatacctccttgtcggaggataccgatgaagacgggcggtccatcatagtctatgctaggccctattttcttaataaaaacgacccttattggccggaatgcctgtccatttcggcgttgaggagggcgtccgcacgggggatgagtctctcggaacgtctgacgttggtgaaagtgaccttggggatcatcgatgcgaggttcttagcgtcctcatgaagtgccagcatgtccggggatttgacacggtactgacccgtcatctgccttatcaccagctgggagtccatgacgaactcgacctcgtccgcacccagctccagggccttggatatccctgctatgagcccgcggtactccgcatagttgttggtgtgtacccctaggaactcggcatgctcgtggacggtcttcccgtccttggtcacgacgatggcataggcggaaggtcccgggtttcctctggatcccccgtcggagtatacgcagtacatcagtacgtgagctccttggccactttgttgtccatgtccaccaggaccaccttggcctttatgggctcgtcggtgagctcatagcccattattatgaccttatcccctacggatgcgagtctggctgcggccccgttgagtgcgatgatgccagaacctctttccccggggaggatgtaggtctcaaaacgtgcaccggtctcgacgaccgcgacggtcaccttctcgccgacccacatcccgcatctgtctacgaggtcggcatctatcgtgatgctgccttcgtagtcgagcctggcctccgtcaccgtggccctgtggatcttgcttctgagcatccagcgcatgattttctctatttatatgaggggtttaaaggtttccatgttaaaatctttttaagtgttattattttaaaaataagatgtcatttagtaacacgaaatcgtataaatgtgtacaagagtttataacaatggcttacatcagccttgtattcagcacgatgctgtttcagtgatcgaaatgacaggcagtatgaaggcaatggtcgcattggtccttgtttccgcactcgtctcgggcggcatagcggtaagcgactcctccgatgcggatgaaggattcacggtaacggattccactggaaagactttcacatattcggcggcgtcggaacacataatcgtgacagggtatgccgccaccctcaccatcatagagtccggcatggcggagaagatctatgcggtcgatcagtatggggcagtcgccttcgacgacaaggggttggaacgcccggccaatgtgtggaccaccacatacaatgacacgtccgctttgaaatccaatatagtccatgccggggaaagcggtttcgacattgcgacggataccgtcatactgacgacctacaagacggatttcgtgggttccgacggcaacagcggacttcgtgaggaactcatgaaggaggggttccgttacgttccgttctatggcagtatcgtcgattacaatgcgatcgtcagctgtgtgagggatatcgagaacataaccggaagtatatccaatctcaccgcatcgatgatgtccgcatacgacgaggtgactgcggcagtggcatccgaagagaagaaggatgcgatattcctcaggtattccagttccaaagggtgggggataggggtgtccggttccatagccgtagccctgttggaagccgcaggaggaaacaacatagggagttccgcaggcaaggacaccgtatacaaccagatgaagatcgtcaaactcctttcagatcacccggatgcgttgatattcatcgacagtccttacttcgatacgtacgaagggaccttcgacaagttcatagacgaggtcatgggaggggaccagggtaaccatggtatcgtgaagatgctcaagacctggaacaattacgaccccgcagccgcggacggactaaaggcggtggcccacgtgatgcatcccgatgcggtcgacgggacgctggaagcgtattatgccgacaaaggtgacggcgacagcagcgtgatgctgtatgtaggtatcggggcggccgccataatcgcagccgtcggggtactgttatttatccgttcgaggaattgacggtaatccaacatgttcggaacaccaggtaggaaacgcaggttgctggtctgcacagtagtggtcttggtcatactcgtgatagcggtgatctacgacctcacctgggccacgtaccgcatatccttcggcgacgtcgtggacgtcatcatggggaacggtacgtgggcgaacaacatcctcgtcaaagacaatgcacagagggtggccatcggagcattggtgggttccggtctggcggcatgcggttgcgtcatgcaggcggtcttccgtaaccctatggcctccccgtacatactgggtctttcatctggggcatccttgggagcggccatcggactgattttcaccatcccgttcatccccatggccgtggccacgcctttgctggcgttcatcacctgtcttgccactatgttcctcgtctacggtgtcgcccatgtagggggttccacccatacggagaccctccttctgaccggtatcgccatctcttccatgatgtccgccgtggtctcattcctgaccttcatagccggggacaagatggaggacatcgttttctggagcatggggagtctaagccgtgcggattggggggagatagcagtggtggccccgatggtgttcatagggatcgccgtgatgtcctgctattcgaagagtcttaacgcgataatgatcggggattcccatgcgatggatctaggtatagaggtggggaagactcgtctcatactgctcatcgcatcgaccgtagtcaccgcggccgccgtatcgttcgtaggtgccatcggtttcgtcggtctgatcatcccgcacatattccgtataatcctgggtcccgataaccgcaccctgctgcccgtaagtgccttgggaggagccgcattcctgatattgtgcgattatctggcacatgtcgtggcaccggaatacggcgtccttcccataggggtgttgacagcactcgtgggggcaccgtacttcatctatctcctcagaaggaggaaaagcgaggtgggttggtcgtgacgttcgaggtccgtgatctggagttcagatacagggagaagccggttttggacggggcctccctcgagataaggtccggcgaggtgttcggtatactgggtcctaacgggtgtgggaagactacacttctgaagaatctcaatcgtaatctgagaccgaattcgggatccgtcgtggtggatgggagcgacgtctcggagatggccaagaaggacatagccaagatcgtcgcggccgtaccccaggcgaacgagatcaggttctcattcaccgtaagggacatagtggccatggggaggatgcctttccagaggcagttcgaaggggacagttcatccgatctgcagatagtggaccaggccctgaaggacgtcggtctctacgatatgagggatctccacataaacgagatgagcggaggggagaggcaaagggtgatcatagcaagggcactggcacagactcccagatacctgctcatggatgagcccacgaaccatctggatgtgaacatgcagttcgaggtcctggatctcgtacacagactctcgagggagaaaggcctgaccgtcgtcatagtctcccacgatcttccgatggcatcccgctattgcgacaggatagccatgatccacgaccatcgcgtcatgtgctgcggtactccggaagaggttctgacgcctgagaatatgaaggcggtattcaacgtggacgcagagctttccgtcgacagtaagacgggaaagcacactgttcttctccacggggtcgcacactgatgcctttttcaattcctaactatcggaaaggaatgtgatggaaggacccagagaattgattttcagaagaattggcgtcccggctggaattcgaatccaggtcgaggcctcgacagggcctcatgataggccactacactaccgggacgactaatcctccttattgagatttagtatttaatccttactaatgtggtttttaaatcggccctttcaagacgccagcatgggcaggagttaagttggattgaattagttggatgtatgctccaaatgtttaaattccatattggatatatatgccaatatcattgagttgatccaatggaaaagaaagcaatctatgtggtggccatcgtcgctgtattggtggccgcctccgtgggagtgtacgccgtcgtaggaaacaaggacgacgtcgacagccctgcatccatggagggtgcggagctaaaggttctgggtaatgcgaacggtgaccgtgtcatagacagcaaggacatcgacgtcatagagaaagcgatcgatgacggcgtggctttgaaggatgcgcctcttgccgatgcgaataacgatggtgtgatagacgacaaggacatagaggtcgtaaagaagatcatcaacaaggaatccgtgaccgtctggcacataaactatcatgacgtcgacggggattctaccatggatatggagcgcgtatccacccaatatcctgtctccgccgccatcatgaccgggtcggccaactcgttcattatgtgctacatgatcggcatcatcgacgagatcaagggtgcgtcatacggatccagcaacgactccaccctcttcgggagcacctatctgaacacttccaagaccgtcaagctcggtacatcgtccacctccattactttcgaggacgggaaggcgggatcctccaacgtcatcgcggagaaaggggtcacatgcgtcctcagcgactggaacaggacgtaccttaccaacgaatcggccttcgagaccgccggcgtggatgtcgtcagggtggcggccgcttctgtggacaaggaagtatacacccattccatactcctcctcggattcctcttccagaaggagagcagggcatccgatcttgtggatctgtacgattccaccatgaagaccatcaaggacgccgtctccacccttcccgaagacaagaaggtgaaggcggtggcatcctccatgaacggatacatctcctccggaaactccgattaccaggcggtcctcgatgtcgcaggtgcggagttcggactcgcggattacagcggattcggttcgaccaccagtatcaaggtggtggaccacggaagcgtattcaacacctccctctacgactgggactacatcgtccatatcaggaccgccctcggatacggaacctccgccgccagcgccaagacgtattgggacacctatacttcggctttcaacgcatggtcccactacggggaggagggaagtcagatcatgatcagcggtgcggcgcctgtgcccgtaagggtcgcttacgccgcatatgcgatgtatggttccgtcctcggggaactgagcgagagctgggccgacggtgtgcaccagaccttcatcaccgatttcttcaacggcgacaatacgaaactggtcgcatcggacctgctgatctgctgcaactcggctccggcctgaaacctattaccgggggagggcccccggtacaactttcttttgggcggacggtctctatatgggcgacaatgatgaaagtacacagatgaagaaggaatacggccactacaccttcaggaaggtcgtcttcatctccgtctcgataatactggtattcatcctgttctgggtgtctctttgcgtaggtacccggagcctttccatagaccaggtctactctttgttctgggaccatgtgaacgggatcgtctaccccaccaattcgcaggagtggttcgacgacaggatcgtctgggagtatcgcgtcccccgtgccctgttcgccataatcgcaggtgtatccctggccgtggcggggtccgtcatgcagagcgtcatgaagaacccgttggccgacccgtatacgacaggtgtgtcgtccggtgcccttttcggggtggcggtcgccatagtgctcgggttggccgtcgggagcggagggatcgaagggataggcgtcgtgataaacgccatgatcttcgccatggtcccggtggtggtcatcgtcctgatggccccattcttcaaaaaatcgcccgcgtcgctcatattggccggggtcgccgtatcgtatctgttcaattcgctgacgtcgcttctgctgataacgaccgatgcggcgactttgcacatggtgtacatatggcagatcggttccttggcagaccttacctgggatgccatacctctgaccttcctgataaccttggccgggcttctcatagtcctgccgttggccaacaagctcaacctcatgtcgttggatgacaagaccgccaaatcaatgggtctcgatgtggagaacctccgtatcctgtgtctgtgcatactgtccctcatggcgacggtggtgatcagctacgtgggagtgataggattcgtcggtctcgtcgtcccccatatcgtgaggctcatactcggttccgataacaaatacaccctccccgccaccgctgcgttcggggccctgttccttctcgggtgcgacatcatctcgagggcgatagatgtctcggcggccatacccgtcggagtggtgacctcgttcgtcggagccccgatcttcctgtatctgataatcagacagaagaggaccatgtggtgatcccatgaccgcggaagaatccacgaaatatctgaacagcaagagacgcagcacggtgttcatcatcgtgttcgtcgccgtgatggcggtcctggcgatctattccctttccgtgaacaatttcaaaatgtcgttctcggaggcatggaccgtagtatgggaccgtatatgcggaaacatacccgacagggcgaccgactactatggttggataagggactacatggtcatggagcagagcgtcccccgtaccgtggcgtcgatactggtgggggtcgtattggccgtgagcggtgccgtcatgcagacgataacccgcaaccctcttacggacccatataccatcggtatatcctccgccgccatgctggggtactgcgtagcattggtctacggcgtctgcgtcataccgttcatagggggagatgccgcgacgatggtcaatgcgttcgtgttcgccctgatcccgtcggcggccataatattcgtgtcgtcgttcaagaagctgagtcccacgatgatgatcctcgtcggtatcgggatgatgtacatgttctcctcgttcagtacattcatcaagttcaatgccagcgatgagagtcttcagcagatctacgaatggggtatcgggaccatgagcagtgtggggtgggaggatctcctgcctcttctggcggccgcattgctggtcctgacggcgttcatgctgctgtccaagaacatcaacgtccttaccgcaggcgacaaggtgtcccagagtctgggtgtcgaccccgtccgtctgcgcataatatgcttcctgctgatatccgtggccatcgcggtggtggtctgcaataccgggaccataggtttcgtgggtctcgtggccccccatatagcgagactgttcaccggtaacgacaacagacttctgatcccggcgtcggccaccataggggggatgatggtccttctgggcgacaccttggtcaggctgcttccgggaggtcttcccgtcggggtcataaccgctctgataggcagtccgctgttcctgtacttcctgtacaggcagaggaagcacgagaacttctgaggcctcctcagggaggcttcggaatcccccatccgtaccatatatggtcatcttccggccatcggagtttcaaatccgtgagggctttggattcgagtaaggtatcggaataatccctccagatataggggccgatacagcattgtccaccctatcaggacggggatcgagacatatgggcaatgttccagtcgatccttttcgcatatcatgtgtccgagggatgcgatcaccggctgatctgcactcgtatggctattcgcgagctgtccgaatccgctgcagtaggcgtcatatggaggtgatgatccgggagtgctcagatgcggctccgtcctcggaaggatatcgggtttcttgcaatggtcgttttattcagtttccgggctgtataatataatgccgtacatgacccagacgtttaatttcggagcattacctttagttatgtctgcgacatcgccgctctttccgatgtctctggtgcggtcaaagaccttggagcaaataattgatatcgcaggcgacagtgcccatcgcctgcgattggtcggggtgcggtaaaagctcaccacgagtattttttcgcctgtttgatcagcatatacaggaacaacggtcctcctatgactgcagtgatcactcctacaggtaggccggtccctatgcatttcgcggcacaatccgaacacaggagaagcatggccccgaacgccgcggatgcgggtatcagatatttgttatcggatcccaggaatatcctggcgacatggggtgctacgagtccgatgaatcctatcgtcccggtgaacgatacgagggtggcggtcaccagggatacgacgatcagtgacaggagccttatgcgtttggcattcacgcccaggctcacagcgtccttatcgcacatagccagaatgttgagtttcttggacaggagcattatggctacgacgcccacgatggccgcagacacctggaaccagatgttgtcccaggtcgattttccgagagttcctatgttccacacatatatctcggacagggattcctcggatgcggtgagtttcatgaacgtggtcgccgcggtgaagaagtacatgaccgcgatcccgatgaggatcatggtagcgggggacacgtcctttttgaacgtcgatatgatgacgatcatggccgcgggtatcagggagaatacgaatgcgttgatcactatggccgtatctccgaacgcaccgggaaggaagctgaatcccaatattatcgccaatgcggctccgaacgatgcacctgcggatatccctgtggtataagggtctgcgaggggattcttcatggaactctgcatcgcagctccgcacacgcccaatcctgcaccgaccgcgaatccggctatcgccctggggaagcgtatgtcccatacgatctggtccgtcccttttccgagttcctccggagggacattccccaggatgtggtcgataagggccttgtacgaatcgatgaatcctatttcatatgcgcccatcgacagttccaaacctatcgctatcaccgacacgacgatgcatacgatgacgaaggtcactttcttggatagatatctgtaatatgtgttcttgaaatgtgtcagggatccgtccgaagaatggtccatattaccacatctccttcctagagcggatgatgagggccaggaatatcggggcccctatgaacgacattaccacccctacggcgatgctgccggggtagattatgagtcttgaaatgaggtcggctatcaggaggaacgccgctccgaacagggcggaggccgggatcaggtatttgttgtccgctccgatgatggttcttacgatatgcggggataccagacctatgaatccgattatgccgacaaatcccactaccgatgccgtcattacggaaaggactgcgaggatgaccatcctgaacgtctccgggtcgatcccgaggcttttcgcactcgcatcccccgttgtaagaagattcagtttaggcgataccagcagcatgaatatggtgccgacgatagttatgatggccatgaccgggacatagtcccagttgacattctccagcgtacctatctgccacaggtatgcctcctgaagtttttcggaggacgtccctatcagaagcaaagtgctggctgcattgaacaggtacgacatcgccacccctgccaatatgagtgtggcgggcgacgaatgcgtgaatctggatatcagtatgatgaccgcggcggggaccattccgaatatgaatgcgttgagcaccaggccgtacatcccgatgctggtgccgagtccgaatcccaatacgatcgctacggacaccccgaatacggctccggacgatattcctgtcgtgtatgggtctgcaagggggttcttgaccgcggattgcatcgcggcgccaccgactgccagacatgctcctgctacgatacccacgattatgcgggggagtctgacgttccatatcgcatagtcgtcatagaacgcctcggtacccttggcagggatgttccccgtcaagtggtcccagattatcccgtacgcctgagtgaagcttatgtccctgccgccgagtgtcagagccaccccagatattatgaatattgatgctaggacggccgttgtgaacagagccttcctcatgacatatctgtgatagtcttctttcagatcggccttcccagcatcttcggtcattcgctcgccttcacgaggttattccgaaatcggagtcggtcaggacgaatttcatatcggtcaccttgtatccttcggaactgaggttgtctatgaaactgtctatgtattcctggtggactatgtccccgtaatcggctccgaagacctccggatacaatatcgacgcggtgtatgcgagcctgacgacggcaggcatgttcccgttgatcatgtagtagttcccatccttcacggtctggatcgcatcgaagttctcgcggtacgtgttgtacatggacgagaggtccgccgacgtgtcgtagccgtagttatggaagtggatgaatacgtcgacgtggtatttttcgttcaaaagccactcgtcaccgtcattgaactgtttggtggtagtggaccaatcggcgacattgtttcctccgcacatcgtggtgaggccgtagaaatcggatatggtcccgctgacatgattggccatcgtggcgcacaggcaggtcttcacatcgccgctgtcgatggtgttcttcttctcggtgacatgcgagatgaccttgtcgcagaatttggcgtatttgttggcactctcttcgagattcagcaggtagcctatggtaagtgccacactgatggccttcattccgtcggaggaggatatacgtacgacgtcgatgcctgcctcggtgaacgtcgattcgttcttgaggtaggatttgctggacatcgttataatcgcatccacgttgcctatcttggtgacggcatcgtagtccgccgcgaggaggctggtacttaccttgggaaggtccttgaaatcggagaacaggcaataatccttggtggcctctccggtggtccctacgactttcccggccttcaccgcacctaccgcctgcatggtcagcgcggcgttggtcccgaccacgaccgtgcggttcaaggggtagctgacgcttttgatctcatcgttcccgttcacataatagatggacatggcctcgcggtctatcatcctctcgaccatcttcctgtcttcagagtcgacctttccgtcgttgttggcatccgccaggggatagtcgtcggaattcacggtcccgtcgagtatcgcatcgatggttgcaagatcctctttatccagatagtcgtcgttgttggcatttcccatgatggccagacggccggtgttgtctgtggatctgtatcctccttcctcatcattcataaggaggaatgccccacatcctgccgtgatgacaatggctatcgcggctatggcgattattttagagttcattttgttccatccttgtattggatatatattccaactattggatgaatcatccaattatgccacaatgttaaattgtttgcggtttgggaaaagtcattctcgaaaattggattgattaaaagggcataatgtcgattggattaatatgccaacacttttataatttgactggatgtattatccaactctaaaaggccagttcatcgccttctgagaaaatcgtgataaaatggaaaagaaaatgactacgatgatcgcagcagtcgcagtggtcgccgtcgttctggtcgccggagcattcgtcatccttaacaacgacgatgacgggaccaagaatgcagccatcgcatcacagctgcagatccgcggtaacgccaacgatgactataccatcgacggcaaggatctggatattgtaaacgatgttatcgcaggtaccaagactttggccgagtaccctcttgccgatgtcaacaacgacggggtcgtcaacgatgacgacgtctccctcctcaaagacctcatcgacaggaaggacgggaccaccgtatacgtggtctgtctcgacaggaacggcaagtccaccaccgtacaggtcacataccctctcaggaacgtcgtgccctatggaaccaacatgcagcttccgaccctctatgcgaacggcggacagtatgtggtcggatacttcgtcagcagctataccactgccgaggcctccatctccagtaccgcgagggacctcgaagggagccagaggagcataagcgatgccgcatggtccaacttcaccgcactggatgcaagcataagcggaggtctgggagcgatcctcgtggattactccggtatcgcccagatatcggaaaagcgcatgggcgacctcaacgacgccggcatcccgatgatctgctacgaatccgccgatgcgaccacagagatcaccaccgtcctgaccctcggattcctcttcggaggggaatgcgagaccatgggcgtgaagtatgcacagaccgcctggaacctcatcgaagagatcaacgacaagctcaaggatgtgaaggacgaggacaagacgtcctacatctgctgcaccatgtacatctacatctgcggtgcgagctcctcgttcaacaccagtgccacaaccgccggcggtgtagcctacgcctccctcaactccgatttcaactccacatacaccaagaactccacgaagatgaccagtgtcgaggccctgtccaaattcacggatgtcgatgtgatcatcaacaaccgttcgatggattggggtctgaccgccgaagagatcaaggacctcgtcatcgacacctgggaccatgacaacagcggaaaactctctaccgcgtatttcgccaagttccttgacaagctcgtctatatcgacaaccttcttcccggagctgtgaagcttgcatacatggcacatgcgatgtatggggacaccttctccagggaatgggccgacggagtactccaggattacatcgatatgggaaccctgcccctcaagggacagaccctggataccgtcctggcctacatcgacctcagtacctacaacgccgtcacggcctgaaccatcttagcagggggccctgccccctgcacataagtgataacatgacatccgacgacgaagggccgaccaaggacgaggtcatcagcgaataccatcatcttatggccagaaggttgatcctcctcctggtctgcatcgtagggataatccttttcgtcggattgttctccctatccgcatacgaaggaatctcgctctcggacacatatcatatcatctgggaccacatctgcggtaacgagtacgagaagaggtcattgttctggtgggcggacagatacatctggaacaccgcgatcccgcatgccctcgtggcgataatcgccggtgcatcactcgctgtctgcggagcactcatgcaatctctcatggggaaccccctggcggatccgtattcgaccggaatatcctccggagcatgcttcggggccgtcgccgccatcgtcgtgggggtgtcgttctccagtgttaccggcgagatgggtatcgtcaccaacgcattcatcggtgcgttgatcccggcgatgctgataatattcatctcggaaagggtccgcatgacccctgccacactgatcctcctcggtacggccatatcgtacttcttcaactccatgataacgtacgtcatggtcacgaccgatgcagacaccctgaagagcgcatatctgtggcaggtcgggagtctcgacgggatgacctggtcttccgttccgctcatgctcgcagtcacgatcgtgggttccgcattcgtcatgatggccacaaggaaactcaacgtcatgtccttgggagagaacagtgcgataagcctcgggatcgatgtgcagaaattcaggatcatatgtctggcacttatggccgtcatgaccgcggccatcgtctcctacaccgggataatagggttcgtggggttggtggcaccgcatatagtcaggctcgtcatagggtcggataacaagttcgtggtaccgatctccatggcggtgggtgccttccttctcctgttcgccgattacatcgcataccagctctccaacatacccgtgggcgtggtgatgagtctgatcgggagtcccgtcttcttcatactgatcgttctgcagagcaggaagtcgggggtgatctattgatgtccgaatcagacgtcctgcgtaaggactacagggcttcgaaccacaggaaactgctgttcaccgccctgttcgtgtccatagcggccgcggccttcttcctgacgctgggtttcggggtttacgagatctccgtctcccatgcggtggaggtgttcttcgatcacctgtccggcaacataaccgacgaggatggggattattacgtctgggacgtgagggtcccgagggccataggtgccatagtcaccggtgccgccctttccgtggccggtgcgatcatgcagaacgatttcaggaatcctctggcggaaccgtataccatgggtatatcttcgggagcgttcctcggagcggttctgagcatagtctgcgggatatccgtcataccgttcgtcaccgggaccgccgtcaccatggtcaacgcattcctgttctccctgataccgacggccatcatcgtcactctctccaaattcaggaagatgacccctgccgcgatgatattgacgggggtcgccgtcatgttcctgttcagttccatatgccaggtcctgatggtcaccgccccgtcggagagtctcgcggacgcctacatgtggagggtgggggacataggaagggtctcctggagttcccttcccctgatgacggtcgcatccgcggtcataatcgtcctcctctacacgatggcaggaaagctcaacgtgatgtatgcgggggacaggggggcgctgaccctgggggagagtgccagccgcataaggctcgtcacgttggtcctcgtatccttccttactgccagtgtggtgagctacaccggtacgatcggtttcataggacttgtgggacctcatgtggcaaggatattcgtcggttccgacaacaggtatctcataccggcttccgcagcattcggtgccgcattcatattgttggccgacaccgtagccaaggtgtccggtgcaaacggtctgcccgtcggggtcatcagttcgatgatcggaggacctctgttcatatggatcctcataaggcagaggaagagcgcctgggcatgagtcccggatcccggacggacgttgtatccgtccgggatcttccgcccccatcgtgaaaacgcatatagccacagatatcatccaggatgatgctatggcagcaacggtcggcgattacatggtgcgtaacgtccagtacgttacccccaacatgacggtcaatgaagtaaaggagaagctcatcaattccaacttccacggcttcccggtggtggagaacggctatctgctcggttatgtcacggccaaggagctcctccgctacatggatacgcccaatgccaaactccgttcggtcatgagcaggggaaccctctgcgtgatcccgaccatgaatatcgacgatgccatgcgcgtccttttccgttacggtctcaggaatctgcccgtcgtcgacgaggagaagaggatcgtcgggatcatctccaacatcgacatcgtaaggtcccagatcgagaaatcccgtcccgggaaggtcatgaacgtcaagaacttcatggaacaacagaacgggataaccatgagggtctacaatgcggagatccccatcgaccagatgatccccacccagaaagaggtctacatggacgaactcatagggcgccagtatgagataaagaggggtctgaacgagcctctgatcgtcatcaagaggcacaacggatatctcgtcgtggacggccatcaccgtataatggcggcccaccgcatggggctcaagatgttcaagtgcatcgtactggagccgaacaacatggatgtccctctgggtctggagaccacggcggagagatggggcctccatacactggacgacgtgaagataatcgagggttccaagcatccgttcatggagatcaccaccatgctcctgcccaaggagcaggccgagaacatcaacaagatcctcatagaccgtatggacgaggatcccggaccgggtgtccccagtgcattgagtccccgtataaccaggaaatcgtcatccaagaagctgtcctccgacaaagtgccagcggccaagaagacggtctcccggaagacttcttccaaaacgggtgccgaaaagaaggcacctgcgaagaagactgcacctaagaagaagcaggacggggaaccgggacagtgatccaatgtgccagacttcggtccggccacaaatcctatttctatatttttgggtaaagtttaattttgagccttgaaaagttgggtaaagtttaattttgagccttgaaaagttgggtaaagtttaattttgagccttgaaaagttgggtaaagtttaattttgagccttgaaaagttgggtaaagtttaattcacatactcccatattcttccgtgttgaagaggaaagcctactcggatttaatgaaatggaaggagaaggaagggcacaagcctcttgtcgtaaccggtgcaagacaagttgggaagacctacctcatagattattttgcaagaaagaactatcctcattacatctacgtggatttctcatcgatggtcttaatgagaaaggcattcgaaagcaatctcgatgtggacaatgtcctctcattgatgaacctgtatagcgacaaacgtcttgattttgtacccggtaagaccttgatattttttgacgaggtgcaggaatgtccgagcgtacgtacggcgttgaagcaattctcattagatggaagatttgatgtgatagcatcaggctccctgttgggagttctcaatcgcaggaattcaagcatattctatccagtcggatatgaggagcagtatgaactccgctctcttgattttgaagaatttctttgggcgttggatgtgccagaggatgcgataggcatggtctgtagatccatacgtgataaaagaccattgggcgagtctctgctatctcgttttttacaactttttagagaatacatggtcgtaggcgggatgcccgaagcagttgtcgaatatgtaaaaacccggaatgtattcgacgtcaatgaaatccataggatgatcctgaggacgagttatgcggatatgagccgctatgtggattcacccaaggagcagaccttggtaagagcatgcttcaactccattcccggacagctttctcagaccaataagaagttcatattttcctatgtggatgaaaacgatggcggtgacgggagcaatgctactgcggataagtatcgtttcgctctttggtggatccatgatgcgggatatgctaacttctgtatgcagataagtgagccagtggtgccgatcgaggccaaagtgcgtcaggatgccttcaaggtgtatctgtatgatacagggatattgatgacactgtacggtgtagattcccgtatcgcactcgcaagtgaggattattcggtcaatatgggtgcagtcgctgaaaatatcgtggccgaatgcatagtcaagtccggatttcctttgcgttattatgttaaatccaacgggaccgatcgtatggaattggatttcatcgtggagtgcgggggtgtaaacgtcatcgaggtcaaatccgggaagaacaggcattccgcatctctcaggaaagtttcaaacatgtatccgataaatcgccgtataatgttcgatataaccgacatacgtgtcgatgaacagggcatagagcattatcctctgttcgccgccgcattcatccgcgacgtgctgggtatgtgatggaatatccgcccatatcgaaatcaagcggtctgcggtttaagtttgctacaacagaagaccgagaccggataccgataggcggtcggattttaaaaaataataggtcccgcccctttcgggacgggacggtgtttctcagaagtcgtcctcgtcatcgcaggaagggcggttgaccttcctggcggcctggaggaggaccctctgctcggcggaggcgatgatcttcttggtcctgacgaaggtgtcggggttcagggagatgcagtctatgccctgttccacgaggaattcacagaactcggggtagaccgaaggcgcctgtccgcagatgctgacatggttgccgtacttgtgggccacctttatgaggtgcttgatggccgcctttactccggggttcctctcgtcgaagtaccccatcttgccgagtatgtcggaatccctgtcgcatcccatggtgagctgggtcaggtcgttggatccgatggagaaccagtcgcagtacttgcagaattcctcggccatgaagatgttgacggggacttcggccatgaagtacagcttgaggtcgagtccgcgcctgaggcctacggactccatcatggcggtgatctgcttgacctcgtcgatggtcctgacgaaaggcagcatgatgttgatgtttttcatgcccatctcgtccctggccttcttgatcgccttgagttcgcacatgaatgcctcgcggtagctgtcggagacatatctggaacatcccctccatccgatcatggggttgtcctcgttgggctcgaagttcgctccgcccttcatatcgcggtactcgttggtcttgaagtcgctcgtcctgagggtgacggggcgggggtagaaggcccttgccaccttggccactccgtcggccagcttgtcgatgagttcctgggcgcgtccctcctggatgaccgcacaggggtgctctccgatgtagttggtgaacaggaactcggatctgaggagtccgacgccgtcacaggggagtttggcgacctcttcggctttggagggcatgctcatgttgaccatgaccttggtcccggtgatggggacctgttcggagaagacagctgcggaagcagcggcggcgggagcggtctcggtgactaccttcttcttgatctctccgcggtagactgtaccggtggaaccgtcgacggtcacgatctccccgttcttcagggtgttggtggcctcgccggtacctactacgcagggggtcccgagttccctggagatgatggcggcatggcaggtcatacctccctcgtcggtgacgatggcgacggatctgctcatggcggggaccatgtcgggcatggtcatcttggtgacgaggacgtccccgtccttgatgacgtcgaggctcatgcctacatcgtatatgcagacccttccggtggccattccggggcttgctccgagaccggagaggacgacgtcccctccctcgacctgttccccggcggagctgtcctctttgccggtaccgatggcggtgatgggcctcgcctgtacgaggtagaccttgttgtcctctatgcaccactccatgtccatgggcttgtcgtagtggatctcgacctgccttccaatctcggcgatctcgagaacgcggtcgtcggggatcttctggaccttctgcatgtccacggggatgtccttcttgaccgctccgccctgaggtccgcggatgtatttccaggtctgtttggagatcctcttgttggtgatggccatcttgctcttgtcgacctggtatgtatcgggggtgacctctccgccgaccatcgcctctccgaggccgtatccgccctccacgatgatgttcttggcaccgttgtgggggtctacggtgaacatgatgccggcgaactcggagttgaccatcctctggacgacgacggccagcttcacatcctcgtgggagtagccctgggtttccctgtaggagatggcgcgggcggtgaagagggatgaccagcatttcctgatcttgtcgaagaggtccttctcgtccttgacgttgaggtaggtctcctgctgtccggcgaaggatgcgtcggggaggtcctccgcagtggcgctggaccttacggccacgaatcccttcttccctccgaggaggagattgtagttctccttgatctcgtctttgaggtctttggggatctcgcatttgtcgaagagctccctgatgttgttggaggctgctacgagggtgtcgtcggaatcggggtcgatcgacttgatctgcgcaaggatcttgggcatgatcttgctggtggagatgaagtagtcgtaggatacggtggtcaggacgaaggcgtggggtactgggaatccggaggaggtgagctctccgaggtttgctccttttccgccgacgatgggcacatcgttgacgcggagctcgttcacatcgataatcctcttggctgcggttttgctgtccatatcaatccctttaatcggaaccggttttcgcggagaacctctccgtgctctgttctgtcgatttcgatgatgagcatataaggctttgcaaatcgggtattcgggaagggtctgtttttcattcttttttcatgttcggtcatgaaaacaccgtttccggggaggtttcccgggttttgggcaataattatattttaatttattatatctgaaaatataatttaaggagggaatagaacggaccatcttataggacgcaacagggagatgctggtcttggaggaccagttcagggcggccggctcctctttcgtggtcatatccggcaggagacgttcgggtaagaccacggtcctcatgcagttcatgaggaggcacccgaactccctgtactttctggccaggaaggagtcatcctcccggaatcttgtttatttccgcagggccgccgccgatttcctcggccgcgacctgggaccggcgtccgacggggattggaacaggaccttcagagagatagtgtcgcggacggggggtcagaagatggtcatcatgatggatgaattccagaacataggtcagaaggaccccaccttccctgcggtcatacaatacatatgggataccgtcctgaaaggtgcccatgtgatgctggtcatcagcggttcctccatccctcagatgtcggcacaggtattggaatacggaagccctctttacgggaggcgtaccgcccagataatgctcgggcagctgtccttctccaaatgctcggagctctatggggccaaaagcgcctgggaccaggtcatgttctattccgtgacgggaggggttccgaagtatgtgaagacgttcggggggtatcgcgacgtctattccgccgtggagggcaccgtcctcaatccggacagctatctttacgacgaggtcatggcctccctgcagtcggaggtcaccgacatcggcagctatgcctccatactcgggtcgatagcgtcgggtcatcgcaaactgcaggacatggccgacgacctcggtctgaagcagacgggcctcaccaactacctcaaggtcctcatggacacgggtctggtggagagggacgtaccagtgacggacgacgacccgttccgcagcaagaagggattgtacaggatcgccgacaggatgaccgcattctggttccgttatgtctatccgcattcggacctgctcggaaggggggagaaggagaagataatgaatatcgtccgcagcgaccttcccttcgataccatgcgctcggcatacgtggagatctgtaccgagaaggcctgggatatggcgtccgaagggtcctgggacctcatccccgaccgcataggaggatattgggggaaggacgtctcggcggacatcgtcggtatagactacggtgcggaagcaatcctcgtggggacatgcgtctgctcggaatcacccgcaggcccggaggtcctggaggatttgagggatgtcggggggaggctgatgtccgtcacgggggcgggaagggtcgagtatgtcgttttctcgatctcgggtttcgaaggggaatggccggatgatgtggatctggtggaaggtgtctgaggacgtcagtccgcggtcgcagggtcgacggtctctgtgcggatcctggggaatttcccccagaacgcaatggcgatcaggatggtctcccctttcatccccgcatagtatttcttctcgtgtatctgtcccatcgcctcgtccaggcccttatccaagtggttttccgaatcgactttcttcaattccaggattatcggggtcgtcccttccgctttgggtatcatgatcatgtcgacccttccattcccttcttccgtttccgtccttatatcgtatcttctggagagggaatacatcatggtcatcaggaccagctgataggaatatccggatgtgaggttgaggtagcttgcccccaggaggatgtgccgaagggatctctccatatcctttacatctcctttcagaacggcgatattgaacttgtcgaacacctctgagtctaccgggaccatgtgttcgactgctgtctttaccactcctcttacttccctgttcgggatggatacgtcgtagaatccatcgtccgtgcggactgcttttagatatcccgacatcgtcatgagggagaatatggatttattgctggacctgacgtcttcgtagatcagggagtctgaaagacccatgcatatggatctacccatcacgaggtcgcggatcattccgaaattctcgtccgtcgtcttttccagaagccatctgaccacggaatctcctcctgagttggcccagtatgcatcgggcaggaagtcgttggacacatagttcatgatactgaacgggttgtacacatccttgttaccgaagcgatatccgtcgtaccattcttcgatctcctcgaatttctcgggatggccgtagtatgtgagtatgttcttgacttccgtttctgtaaaaccgaaacgttcgtcggatcttacagagaatgtgttgttcacggtgatgttgttgataccggaaaagatgctttccttagctatctgcatcactccggtcacatatgccatctgcacgtccggattgtttttcaatatcggctcgaggaatcctccgaggaagtccaggataggcctgtgcgattccgatccgaatgaatcggataccgcgcggtcatattcgtctatgaggattatgaccttcttcccatgatacatcctgagcatggagcatagcataggtatgcacatctgcatctggtccggggagatgtccatcctgaggattttttcgaataaggcctttttatcatcgtccgtcttatccgagtccagtaggtatctgaacctgtcgaagataccgtatagggtcacttcgatcttctcgatgaaatcctcatatgtctgattggagccggttttggcattgcggaggtccatgtgtatgacggggaacgagttcttgtatccatccagttctgggtgttcggatatggcaagaccgtcgaaccaggtgttccccctataattaatattgaaatatgcgtcgatcatgctgagattcagcgtcttgccgaatctccgggggcgcgtgaatagatatatcccgccgatatcttcgtcgaagatgtccttgataagaagggtcttgtcgacatagtagcagtcttcctccctgatacgtgcgaacgagtaccccccagtatcgatcttcttcacgaagaggtcgagggccggtgtattcataaatatgatccataaggggaaatgccgtgcaggatgtcagccatcccgtttccggatatgccgtgttccgattaagtatgtcccggaaggcattatattaggcttaccgaaaatttatcttcgaaattcgtaaaattcgtcatgaacatagtaaaatcagcaattctttagatgatttaattctaaaacaccattataaatttgcgattttcgtagaagatatacaagggtttaaatccaatggggaaatgccttcattggttgttctaatggacacagagatatgttggcacggaagaggaggtcagggtgtcgtcaccgcgaacgagatcctcgccgaatctgccatatattccggtaagtatgtgaaggcattccccgagttcggtccggagaggatgggggcacccatcagggctttctccaggatctccgacggccctgtcagggtccacacccaggtctacgagccagatattgtcatcgtcatcgaccccaccctcatcgggaaggtcgacgtggccaagggtctgaagaaaggcggtttcattctcgccaactacgaggggacccccgcggagcttcagaaggccatcggcaccaccgccgagtgccactctgtaaatgcgtccaagatcgctctcgaggagatcggaaagcctctcgtcaacactgcgatgctcggagcgctcatcaagatccgtcctatcatcacctacagcgagatggaggacaacatcaccgacaaattcaccggcaaactctccgacaagctgatcgtgaagaacctgtccgccctcaagagggcctatgaggaggtcgagtaaaatggtaaacatggcaggatacaaggacatggtcatcggaagccgtgtcatagagcccggaaactccgaggagttccacaccggagactggaggtccaccgtacctatcatcgaccagtccctctgcatcgactgcatgacctgctggatctactgccccgacgattgcatccttgtaaaggacgataaggtcaccggcataaagctgacccactgcaagggctgcgggatctgctccaaggtctgtcccaagaaggccatcactatgaaggaggatatagaatgagcagcaaggtcggtaaggacatcgcgatcaacggggacggagccgtcgctctcgcctggaagcagatgaaccccgatgtctgtgcggcataccccatcacccctcagaccatcatagtcgaggatttcgccaagtatgtcgccaacggagaggtctccaccgagttcgtggacgtggaatccgagcactccgccctgactctgtgtaccacctcctgcgccgcaggggccaggacgttcacggccacggcgtcccagggactcgcatacatgtgggagatgctccccatcaccgcatccatgaggacccccgtcatgatggccgtcgccaacaggaccgtcagcggacccatcaacatcaacaacgaccacggtgacgtcatgtccgccagggacaccggttggatctcccttttcagcgagaacgtccaggaagcctacgacatgagcatcctcggtcccaagatagccgagaatcccgacgtacagctcccggtcctcgtcaacctcgacggattcatcctgacccatgccatcgagaggatgacccctctcgagagctccgtggtcaaggagttcgttggtccgttcaagccggtacaccctctgctggatgtcgaccacccgaccacccacaacctgatggacggtcccctgttctacttcccgcacaagtaccagatggtcatcgccatggagaaggccctcggtgtagcccaggacgccttcgacgagttcgcggagatctccggaaggaagtaccacctggtggaggagtacatgtgcgacgacgccgacaccatcgcagtggtcctcgggtcctccttcggtaccatgaaggaggccgtcgacaggctcagggccgagggaatgaaggtcggagtctgcatgccccgcgtctacaggccttggcccgcggagcagctggcgaagatcatgaagggcaagaagaacgtcctcgtcatggacaggcatctcagcatcggttcctacggaccgatgttccccgaggtctgcgccgcggcgacgctcaacgacaagatgccccgcatgttcaacttcgtatacggactcggaggagcggacacccaggtctccgacttcatgggcgtctacaagcaggtcctcgaaggcaaggccgacaaggtcaacttcgtgggggtgcacgaatgagcggattatctctcaaggaactcaacaagatccccgtcaggcttgcgagcgggcacaggctctgcgcaggatgcgccgagtccatcatcgcaaggcagatcctcatgggaactgagaaggatgtggcggtatcggtgtccaccggatgcttcgaggtatccaccaccatcttcccgtacacctcctggaacatacccatggtccacaccgctttcgggaacggtgcggccggcgcggccggactggagaccgcctacaagtctctcaagagacagggcaagatcgacaaggatatcaagttcgtcaacttcgcaggagacggtgccacctacgatatcggactccaggccctttccggagcaatggagagggggcacgacatgatgttcgtgtgcttcaacaacgaggcgtacatgaacaccggtatccagaggtcctccgctaccgagaagggtgcgtccaccacgacctcctggaacggtgccgagtcctacggaaagaaggagtaccccaaggacatgaccgcagtcatggttgcccacaacatcccttacgtggcacagaccgccccctatgcatggagggacatggtcaccaaggcccgtaaggcgttcgagtgcggaggaccttccttcatcaatgccatctccccctgtcccaggggatggaggttcgctcccagcgacaccatcgccatatccaagctggcggtcgattgttgcgtctggcctctgtacgaggtcgtcgacggggagtactccctgtccgcagacagtctgaggatcgccgacggaaaggtggagaagaagccgatcaccgactggttcgattcccagggcaggttcaagcacctcaaggatgagaggtgggcccctgtcgtcgaggagatccagaaggatgtcgacaagaagtgggagaagctcctgaagctttgcggactctgataaaaccattcaaaagggcctgccgcgggcccttgaccgcggcgattttccatatcatatcgtcatatctggcacattgcatacgggacttaacttccagtatgtcgtctacgatcccatgatgtcctgcggagtcgacaccatcgacttccttttcattccggatccaaaaaatgcagggacgttcagttcactataagacaaaggaggaatcctattacggctccggaaagtgcggtgacgatgttgttgccgtatttggagatccttcctttgttctcccacaccgccccgacaacgctgtcgaggaggttaccgaccattccgcatacccagactatcaggatcctccaatccaggcagtggaatacgagggcatatgacagtatcgcgaatacaagggacgtgatggccgaacttacaagacccagacgggatattccaccgtttatgccgggctcggtctttttcagagtggttatcatccatacgtccttgtcgaaaacccctatctcgctggatgtggtgtcggctacagatacggcgatggcggcgaggaaggccactgtcagataaggcgaggcccctccgtcgtctatgaaatacacgaccgatacgatggtcggtatcagacctacgcccaatatgttcatatggcctctttcgccggcctttccttcctgaaggcccatggccttctttttctttatcttggtgaatgtggcggcgaacgccattatggggaacagcatatatgctgcgaaccaccagaaattcccgcagtaagctatgatcactgcggatatgaaagatgccaagatccctgtgttcgtcaggaatcctttcttatacgctaccaacagcaacactgcagctacgcatatcgccagcagtgtaccggttaacgtatccatggacctggcatatttttaaaatatataatggggcaggtttttcccctttgtatcagcgtaccttttcgagaagtcttgtggcatcggctatgcattgggccctgtccgtctgaggcagatacatgaccttgccttgggggtatagggtgacttccatcccgttccactcgaaaacgagcagcatctcatccctttccttgatggtgcagccttccttctcgatcacatccgcagcatgtgccagatctatgtccaggatatctgcggagatggccatcaccgcttttcctccgcataggcgggcggtggtgaacctcatctcagggacctcaggagtgcggcggatttctcatggaattcctccagagacgccatatttatcatcatgtagtcgcagagggcgatgacctcccccacgccccacgaaagttctctggagtcgcgggtatcgaactcctctttgttgtggggggcgtcctccctcgcccttttgaccaacctgtcatatctgacggatggggccgcatggacggccacgatgcgtacgtctgctcccagggagcggaacgacctgacctcgtccatgctcctgcatccgtccactatgaagatgtcgccgtacatcctttcgatggccctcttcgcccagatgtcggtcccatggatcttcctctcgttaccggcgaactgaccgacggtcatgccttccttttcggaacccgatgcggcgtaggcctctctcaccacgtcgcccatcctgacgaacggcacacctgcatctatcccggcggagaggaattcctctttgccggctccgggcatcccggtgacgacgatcatcttcatggtatcagatcaggttgtccgatatgttcaggagtatgcggtcgcagtagacgcatctgagtctcggagggttcctgttctctacgaagaacttgggggagacgggctctcccttgttcgttatgcagttggggttgctgcatcttaccagaccgacgaccttgtcgcccagtttcacgtcgaatttctccgccacatagtagtcgcggatgatggatatcgtcgcctcgggggcgatgagggctatcttggagacggtggtctcgtcgagctccatgtcctcgagtttcacgatgtccttccacttcttgctttccttcgtggtggggacgtgcatccctatgctgatcccggagtcgatgttgttctcgttgactccgaggatcttcagcacgttgagtgcctgtccgttctcgatatggtcgatgacggtgccgttccttatcggcgggatcttgatctcggctatctccttcatatgtctccccccagaatggcgcagaggatggccatcctaaccgggaccccgttgaacgcctgctggaagtatctggcgtgaggtgtggaatcgacctcggtggcgatctcgttcaccctcggcagggggtgcatgacgatcatgtcgtccttggcgttcctcagcatcgcattgtcgatcctgtaggtgcctgcgaccttctggtactcggcagggtccgggaacctctccctctggatcctggtgacgtaaaggacatccgcgtcgcctatgacatcctcgaggacgctggtcttcctggggacacaaccgttcctcttgagcctgtccacgatgtcctgcggcatctggagggactcgggggcgaccagggtgagcttcactccgaagttggtcagggcctgtgcgagggtatggaccgtgcgaccgtacttcagatctccgaccatggtgacgttgaggccgtccagggaatccttcgcctccctcatggtgaaaaggtcgagcagcatctgggtcgggtgggatccggctccgtcccccgcattgatgacagggttctcggatacgtcggcggcgagtcttgccgcaccctcgaaggggtgcctcagtacgatgacgtcgcagtatgcgtcgaccatcctgatggtgtcggcaagggtctcccctttcgctatggaggtcatggacatctcggagacgtcgatgacgtcgcatccgagcctgtaggcggcgctctcgaacgagagcttggtgcgggtggaaggctcgaagaacaggtttccgagaatcttgccgtcgagagcgcgtttgactttctctccccgggcataggggaccatcttcttcgagaggtcaagaatgtactctatctggtccttggtcaggtcccggatagatacgaggtccttgtcataaaagtccatgattcacaataggcaacatagatattaacccttagtcctcggagaatccagatgtccgtcccgtcgggtgcgtcatataaaggtgcggatgttttcaggaccgggtgtccggcattcggggagccaggcggctctgcgggaccctgtccgtcggagcgacctacttatattgatgaacgatagcgggtcgtatgcttgacgttgtgagcaggtcccaaaggggaagggtttgcgaatacaggaaaggggacgggtgcatcaggacgcctttcgtcctcaagaccggtgccgccggagataccggcataaccgcaggtgacgacggaaggaccgtacgcatcctcggttcctccgtagacgtggatccccgcctgctcacatccgccgcctccgggatcccggcccagccgaggaccagggacgggatcaccgtcctgaggcttcccgtgagcggtgacgagatcgtccccgacgactcggaggtcgtggtggtccccaacgcattcgatgtgaaaggcgatttcagaaggatggtggaccaggtcatgaaggcgaggaaggccgctggtttcggcagggtccttgtgatgctcggcatagccgaacctgccaatctggcacttctgtcctacatgggggtggacgtcgtggacgactccttctgcagggcggccgggataaacggggtgtccctcatccccgaggggaacgtcgcatcggacgaggattgctcggaggacaacgtctccgagttggacagggaggccgccaaggtcgcccgtttcataggcgccggcaggctcagggaactcgtggaccagaggtccttctcctcggcggacgaggtcgccgccctcaggatattcgacgcggaaggttacgggtatcaggaggaatgctgttccacgaccggatgcaggttctcctgcaacaccgttcaggccctgaggagacccgacatagccagatatcagaaggtcctgtccgagaggtatgtcgtgccttcccataagaaggtccttctcctcctcccgtgctccgccaagaagccctaccacacttcgaagacccataagctgttcgcctccgcgatacacacggcatcccacgacaccctggtacacgaggtcatagtgacatcccctctgggtatcgtccccagggaactggacgcgatgtaccctgccaactcctacgacatacccgtgaccggggagtggaaatgcgaggagaaggccaccatcaggaggatgctcaaggagctcctggagaaaggacattacgagaaggtcgtatgccacctcggagaggatgcggagctcgtggagggtctctgcgacggtatggtggagacggtcgtcggagacccggtatcccccaaatccctggagaatctggataaggccctcagggacgccaccaagggcatggagcccgtcgactatctcgtggaccgcagggaggccatccgttccgtcctctccttccagttcggtaaggatgttgcggacgcgatcatggacgagaacacgtacgggatagggaagttcccctattggaaggtcttccgcgaggacccggagaacagacagaagaagacccagctgtgcatgatgtcccctgaaagggggatgttctccctcaccatggacggtgcggagatcatcgcaggcatgggcaggaacatcgtagagatgcaggacttcgaactgaagggcagtcttttcgccgtaggggtggataaggcggaccacggcctccgtataggcgatgaggctatcgtagtatgcggagggaaggtcagaggtgtcggtgtagccgccatgtgcggtgcggagatggagcagatgaagaggggcatcgcagtgaagatgcgtcattctggctgatatctcagattcggaaaaaaccgtcagattcggtcagattcggtcacccctccccatttggcttaaatagattcctgggaatcgagtaattagaggaaaaagagagcatcccccaaccagtgctcctaacctcggcccgcgcccacatccatccatcccattttcccgcgcgggtcaatcccctttcttcacagggtctttcaacacacatccatcttcttccgcatatccgtccaagatggttttcagagtcatactgccgatagatcccgtccgaagaacgatgacaggtcggtccgggtcacagtcttctaagtccgagcatggccgttatcgcagatgacagcatggccgtatatgctccgatcccggtagaatagatgtagttccatccgacctctgcgcagaacatcacgaccagtgcggcgcagactatccccagggggaagactgccgaacggggacctataccgaaagcgaagtgtaccgtcagaaacactccgatgacggctatggccagaggaacgaagcagaagacgtccgaagcccttccgatatcaggtccgtccatgaccagccccaatccggatatcccggggccgagccattccaggaacagcgatacgaccattgtcagagacagggcgattcccgccacgacggtcacctcgtgtttaacggcgcgggtgctggaggaagtccggacagggtcatcggtcggttgctcttcgcagagggaatccctcagtcccctgccgatcctgtaaccgcactccttgcagacggaggatccgtccggcagcatacaaccgcacttaggacagaacatgatatcatctgccgcatgtagttaggtagataaaacccgttcttcgacatatcttactcgggttcctctgagaactcctgttccgcacttttcctcatgaaccatatcccgacggccagacctatgacgaacatgacggccccggccaatatgtgcgtgatgttctcggcatcccccacggatgttatgatcagtgttacgagcgatccgacggtcagtccgaagatcaggaaagaagtgctcctgtggtggtgctccaaggcatagtggacgatcttggagaatcccagcagtccgaccaccgctccggcggccatggagacgaggaacgccccgtccaggttgctgatcgtgtcggtgaacagggtgaacagtccgaatacgatgaggatggtggaatggctgatcccgggcaccatggctgatatggccactactatgcccacgacgaacattacgaccatcccggcggcgtcgtgtcccaggatcacgtcgtcgctgcctcctgtgaagtacattatgagcatggagcccattatcacgaatcctatcgcaagagcggcccagttcgccctcgtccaagcgctctccctgggtttcgtcatatgatagacggcgggtatctgtccggctatgagtcccgcgaagaggaactgacactccgtcgggtacttgtccatggcgcccgagagtatcttcgcggagacgagtgtaccgatcaatataccgataagaaggaacagtatgaaccagaaatccttcctgaggtagacgcgcaggcgtgcgacgtcgcggacaagacgttcgtatatgccgaagcagacgcatatcaccgctccgctgatgccgggaagcatcgatgcgataccgacgactatgccgacgagtatctctttcaccgcctttgcgcgagattccatatgaggattgacaaccttaagtgtgtatataaagggtggtaacgggttgagaagtagggttgacgacaagttggataatcaatccaacgggtttttataggaattggacgtattatccgttgatataagttagggacataagccgcatctaagcggtctccgggggaatttgagatacacataatggaagggtatcttccgttggaatggtgcatcatctggttcttggtgatgatcccgttcgtggcggtaggtgctaggaagataatcaggatcattcgtgaacatccggagcagaagatgacagtggctctttccggggccttcatcttcctcctgtcatcgctcaagcttccgtcagccacgggctcgagctcccatcctaccggtaccggtctggccgtagtcctttacggcgtatgcgcctgctcggtcctgtccctgatagtcctggtgttccaggctttgcttctggcacatggcgggctcaccaccttgggcgccaactgcgtgtccatgggtgtcgtgggacctatagtgggcatgttcttctgggcccttttcaggaagttcagggccagcgtcccggtctccatgttctttgccgcgttcttcgccgatctgatgacttacgtcttcacctcggtgcagctcacgatctgctaccacgccaacggggtcatgcaggcatttgcggatttcatgacgacatatgccgtcacccaaatccctctggcactcatagaggggataatcttcgccatgttcgccagatatctcgtcacctcccgtcccgagatcttcggcgacgaatccgcacagaagcccgtgtcgaagaagttctatatggcatgcttcgcggtcatcgccgcggtcctggtggtcatactcgcatacggggcggccaacgggttcgagttcgccggatccgacgatgtcgggtctggcataatcatggacaatgcggaggatttcatacagtggaccgaggggatatggggcagttacgagcttcccggggagacggaatccctgcttttcgctctgcaggcagccatcggtgccgtcataatcggtttcttcataggtatatcgtatgcccggaagaagttcgataaagaggggccacgagagccccggccccccgaaataaggaggaaggccgttccggaagcgaagaggagagggtcgtccagcgaccaggtggagatggacgagctcgcctacagctccaggatggtggactggtcgcctctgggcaagctgttcttcaccctagccctcctggtggtcggtctcataacggacagcatagtggtcccgatgatcactttctgtatcggtctggcacttatggcgtattccaccaacatgaagcttccgccggtgatcctcctcgccataggggaggcggtcctcatcatggctatcggatgcggtctcatatcaatactgggtgaccactcccaggaggccctcctgtccgggaagatcctgtggttcgacatgtacatgacccaggaaagtctcaatcaggcctggctggtcttcttcagggccatcgccggcgtaacattgatgctgtctttcgccagttccactcccataccgcatctggcacaggcatgcaggaagctgaggatgccgaaggagatagtggaggtcgtcgtcctgatatacagatacgcattccttctgttggagaggatgctggtgatgctcaaggcggccaagtgccgtctcggatacaacggtcccgtccgcaccatgaggtcgtatgcaggcgccatggttggaacgttcatgttctccatggagctggcggagaaatccgagtcttccctcgcctgcaggaactaccaggggtacttccctgtatacaacatgcccaggaatatctcctgggcatgggtcctggtcactctggcggccgcggccgccctgttcgttttcggacgcgacctcgtaaattggaacgatatggcgggactgctctcgcacttgttcggatggtgacaattttggatgtcttcaatatggaaggggtgagtttcagacaccacgacaatctgccgttcgtcctcaaggatgtggatctcagcataccggagaacggacgtaccgccgtcctcggggccaacggtgccgggaagaccaccctgttctacagcctcaccggggtatacaagccttccaaaggggaggtcctctatcgcggaaagccggtggagtacaccaaagagggtcttacggaactccgttccgaagtcgcggtcgtccttcagaatccagacgaacagatgttctcgtcgacggtggaggaggacgtggccttcggaccgatgaacataggcgtcccgagggacgaggtcggcgagaggatcgacagggcactgcgcgacgtcaggatgtcggattaccgctggtctcctctgcagcagctttcagggggtcagaggaagagggtcgccatagccggtgcccttgctgtcagacccaaggtcatgataatggacgagcccaccgcaggtctcgatccgcaatcttccatggaggtcatggagctggccgaaagactccatctggagggagtgacggtcatcatatcgacacacgacgtcgatctggcatatacgtgggccgacggtgtccgcgtgctcaggcacggccatatgatctacggaggggattcggaaggattctacgaggacatagacaacgtcctcctcagcggtcttctgaggccgtcaactttcagcatgaatcgggagatctcctccatctccggggtggacgagtcgccttatcccaagacggtcagcgaatacctcgccaagttcggcggcgggaacggcgtcaccggcaggatattctgcatcccatattccggaggtccggtgggggaccgctatgccgaggccgtcagggaggccggggatggtgcccgcatcggtctgtacgggacggaatcgagatatgccgccacggacgagtcggagaagatcgatttctacttcgacgggatcgattcctgtctttccgaggccgttctcggaagggattcggtcctcatttacgattctgtctacgagccgatggtcagggagaaggccggaaggctttccgtattcggagcggacatagacatgcaggtgataggatgagcgattacgtcctggagacggaaggggtcacataccgttacgggaagaagtgccagcctgctctttccgatgtcacggtaagggttcgcagaggggtgaagaccgccataatcggggccaacggggccggtaaatccacgctgttcggcatattgaacgccctatataagccggaatcaggcgtcgtacgttacaacggagagcccatctcgtaccgcaggaagagcgtgacgaggatgcgcaccgacgtcgccgtgctgttccagaaccccgacgacatgctgttccgtccggtcgtggaacaggacgtggcgttcggaccggagaatctgggtctttccaaggacgaggtcgagaggagggtcgaggaagccttgttcatggtggggatgcaggatttcaggaagagcgggataatgcgtctctcctacggccagaggaagagggtcgccatagccggcgtcctcgccatgcgtccgaaggtccttatcatggacgagcccaccgccggtctggatccgcagatggcgtcggaggtgatggaactggtggaacagttgcaccgtgaagggacgaccgttgtgatgtcttcccacgacacggacctcacctatgcctgggcggacgagatacatgttatgcagaacgggagatgcatctattccggggaaccggagccattctacgcggacaaaccgtccgtctacctggctggcctccttccacccaaggtgttcctcatgaacgagggtctgtcgtccatgcgcggaacggatccgtccccattcccgaggaccgaggcgcagcttatcagcaagaccgtcccgccgaaggccgggacgggtacccttcacataatgcctgttttggccggtgccgacgacaaggcggtggatgcggcattggcctccgcgggtctgtcggaagcctccaggggaatatacggaaaaagtgccagacgtgcgaaggacatcgccaatgtaggtatagaattcttctacggcgctcccgagaactgcatgataaggtgcatggaagggaaggataccgtccttctgtgcgaccccgccatggtggacgtcgcggtatgcggtgtcggtttcatggaaagggccggtttcgggaagatacctgtgaaggtccttcccgaagtgtccggatgaaggggcctcgggacgtcgggagagatcccccgtgtcccgaggacgttcatttgttgaggtggtcgactacgcccgtgtaggtctccgaccaacccttccagatgttgggtttgtcgtccttgacctccaggtcgtccagcaggaagaacttcccgtggaggttctcggccagcatcttggggatgtcgttcttggtgtaacctaggccggagtcgatcacgatccaatccgaattaggtatgttcaccatcttggatatctccagggcctctttgatggggtccttgtagctatccatcgcctgtgtcgccttcccgtccgttatcaggacgatgtggcacttctcgtcgggatgcttcagggtgtaaggcatcatgtattcgtacaccttgatcagcgcggcgctcagaggtgtcccctgccccacggctatggcatcgatgatcggttctagctgctccactgccctggtgggctggaggatcaggtctatactctcctcgttgaaggtcatcagaccgaccctgtccctcttgacgtagtgggtgctcagcatggatatcatggccgcctttaccttgctcatcctgttgcggattatcagggagccgctggtatcgagaaggaacaggaacgtggacgatatctgcttctgcctgaccttctcccttatgtcctgcttctccagtttcactccgccgtcaccgggtttctggcgcttctgctggtagggtgcggccgccctgatggtggcatcgaaggcgatgtccgggtaccctccgttggggacgcgggatttgatgtacttcccgttacggtccgtactctccacataacgtcttttcgcgacgtcgtcccctgagaaggagccgttgctgtcctccgcctccagaaggtcgatggcctcgaacgtctcaccgatggtggcgacgacatcctccatatcctcggatttgatgaaggcctctccggagttgacctgtgccacggtgacgtcgttctcgttcatccccttgacgatcttggattccgtggtctcgcccttctcgtcgtggatgaatctctttatccctccgagggggttgtatccggtctccagcgggttgtactgcttcttctccttcctcacctggcgtttggtacgcctgtgttccagacagaggagcgccgcctgtgcggtatccgtgtcggtcacgcgcttccttccggccagggcggcgagtgccagagccgcctgtgcggtggagatggcgcccctgcatcccttcacacctatcgccttgcagatcctggctatgttacgcatctgcttctgggatatgtgtacctgtggcaggagtttcctggcggccttgacggccttggcctgctccctgtcgtcggccgcgaagtccctgctttcggagaacgtcccgtcgtagaaggacaggttcctcctgatgacctcctcgcattcgtccgattccttgggtttacgcatggtgacgcacatgtcgaagcagtccaggacgtgcttgtcgatgtacttcctgttggaattcatgctggccagtacggtggtgttgcacctgtacgaggtcgagatgttctccctctcgatgtagaccttcccgtcgcgtacgtcgttgagcatggcggtgaggacgttcgcatcgaacaggtcggcgtcgtccagatagaggtagttccggttagccctcatgaggaggctctcgcccagttccacgctgccggtggctatggcgagctccaggtctatggccccgaacagttgctcgtcggtgacgttgagggggacgttgacgaccttcttccccgggtctatgccgcataccgaacgtgccagggcggtctttccggtcccggacaggcccttgatcaggaccgcctttatgtgcgggttcacggcagcgcacagcaacgcggtcttggcggtctcgtttccatagatggcggagaacggaaggctgttgccgttcacattctggcgagacattccgtgacctcgctctcgtcgaacttggtcttgtcgaaagcgttcctcttgatacggtgggcgaggacgagtgcggcgacgtccttcatatcgtccttggtgatctccttccttccggcgagggcggcgttggccctggcggcgcggatgagggtgatgtcggacctgtgcccctccatgctgaacttcatcgacagtttggcggccatggtgaccgcattatcgtccacggggatctcggttatgagtttcctggcctgttcgatctgtttggtgagggccttcagctcgtccttgcacgagtcgacgtaggcctcggggtcggcgtcgaaggcgagcctcctcttgatgacctcggtcctggtcgttatgctgtcctctccttcgacctccacggacagtccgaacctgtccagcagctggggtctgaggttcccttcctcgggattcatggtacctacgaggacgaacctcgcggggtgggagaacgacacaccctccctctccacatagttgacccccatggcggcggagtccagaagcaggtcgatgatgtggtcgtccagcaggttgatctcgtcgacgtagagtatgttgccgttggcggatgcgaggaccccgggttcgaatttcttctttcctgtcttgagcacatattcgaggtcgagggtaccggataccctgtcctcggtggcgttgagcgggagttcgatgaccttcatcgggaccttgacggtctccagttcctcgccggccgcgatccttgcctgacagtctgcgcagagcctcttggggtagcgggggtcgcaacggtatgcgcaccctttcacggcgggccttgcgggcaggaactgcgccatagacctcacggccgtggatttggccgtacctttctcccctttgatgaggacccctccgatgctgggatccacgacgttcagaagcaatgcccttttcattttatcctgtttcacgatacggacgaacgggaacagtgtctgcatctctgccatttcaaactctctctccttcaatggcggaaggctggccaccttccactcatgtcattggaatcggcctgtcactataaacaatatccgttaatgtgcgttaatggatatgtgcggaaatacttcgtcacatgtgcctatgtaatcattacaatcggaaaaatccggatattttgtacaattgtattaacgtgcatatattgagagaaggcatactatcctgtttgttacaagtcttatatattgacataaggatacattatcaaacccattctttgtagaagattcggaggtatgtatattaaaacaaaatattcggtggcgatggcttttgtcgtcgccctatgcatggtcatgccgtctgcggcggtgttctcctcggacggaggggatgccgaagcggtcggtcctgtgacctatgagtattcgtcagacccggcctcctggccgtcgctttcagatatagatctcggttctattgccggtttcgatccgtcggccatcataggctccatcgagatcgaaggcaagggcaatggagagatcatagaaccgtctgaaaagatagagaccgtcatcgaggtaggccccgacagcgagaacaacgtgatgaaggggaaatacgtattctattccgatggacaggtacgcgtcgccgacggttacgtgctcatattgtctgctgtggatatctccgtaactgcccagggatccgcagtattcgttttcgagaagggcgcatcggtcgccgtatccctcggaagcatcctgggtatggacataggattcaacatctatactttcaaagagaagaccgagatatccttggatgggacgtattcctccaatggatcggaggggtccatcgggatggccttctcggaggggaccgtcatcaaagtcggcgacacgtctgtgaaggccgtcaaggataactccgtcggattcaactattcgatctcgtcctcaacgtcctctcttaccgtgagcggtgccgtatcgttcaccatcggagggatcgagataacctatccgaccggagaggacacttcctatacggtctccgtatccggagacggaagcgtgtcggtcagttatggggaccccacgacagtcctcaaagccaacatgaacatgaacatctccgaggaggatttcttcgacatatccgtaggcatgtccgccaacgtgacgctcgccaacagcgaggacgaggggatctccttcaagagcgggaacgtctccgtcagcatcaaggccgatatgaaactcgacctcggcggcctggaaaaggcgtaccccaaggcggacgtggagatcaagggcttcgagttcggtctcgacgtctccgtctccgagaccggtgctgcaaaggtctccgccagactgtctttggccaatgtatcggccgacataacccaggacgtcatcatcaagtccgcagaagagtccagatccaacagcataagggtggaggtaagcgatgtgcgtgcctccctcgatgcggaggcggcactcgcagacataatggccttggtctcctccggaggatacgatgtcgacgttcccgctatcccttcctggaaatccaccgatttcgaggacatattcgacgatgtccaagacctttccgagtgtgaatgggcattcgcggatgacgaagacgtctccgatttctatgccgccatggatcgcttcatcaaagaccccataagcgggctcgtggacttctacgaactcgacagcgtgtcctatagcatatatggcaacatggacgatctggcaaagtcggtcgcgggaatgcgcgacgtcgacttctccgtcagcctcagcatcgggaacatagatgtggaggtcgagggatccagcatgctggacctcgaggtcagcggcatcggattcgacgtgtccctcgacaacacctcttccgagacagatgccggtgtgaagacggtggcaatgctttccgcagaggcacgtgtgggcggtatcaatgccgccctgtccaatcccagtgtcgccctcgagaagttcgaggccgatgccaaggtctcgttcggcggtaatgtggaatccatctacgccgacgacacggtcaccgtgaataagttcgatttcagcggttccgccgatgtatccctttacatgaagggctacatcgaaggcggaaggatgatgctgtccgtagacggtggaaaagcagcattcgatttctccgacgaggggagatacacctccgtgtctttgggggatgtaaaggcgggtgtacgcggtgccgacctgtccatcaagtcgctgttcatggacaccgattacagtttcagtgtgaaggagatgtccatgaagggtccgttcttcatttctgtcggggatcctgccgcatacaaggattgcgacatatccgtgaagaacctgagcggtgttgcaggcaaggagtattccgtggacagcatacatgcttggatagattccgcaaacggaggcgtactggaactgacatccaacggtaacgacagaacggtctccgtcaacggaggggacgtagattccgacatactgtgcccgatcgacctgttcgacaacattttggtcacgcaggtcgagatcattcccgatggtgcaagcataaccttcgagggggattccctgctcatcgtcgactcgttctacgtgcaggacggcggcaaggtgtccggttccttcgcgacctgggatttcttcggggatgtggccaacaactactgtctgagcgcatatggtatgctcaatgcggatctgggtgtgaagtacgtcgacggcgtactcacgttcttcatgcatccctgggaggggtatgtcggtgacgatgtatccgacttctccggtttcacatatgacaaggaaacgaagatcatgtccatcgagtccgggtattccctcaatctgttggaggccacggtgaacgatcccgctaagttctccatctatgtcgacggtgagaagaagaccgaatgccaataccatggcgttgtgactctgtccatagaggcccccgaagggaaggtgccgctgttcatggtgaatcagttcggcaaggccgtaggggtcctgtcggataccgggaagggtgtgtatgagtggaagtgtagtacctacgaatactcctacgacctctatctgactccctactacgggaccttgagcgaagtgaatacgggtgaggtcaccgatatcggtgacgacggtgcccgtttcgtcattcccgaagattcggatggcaccgtgacggtcaagacgtcctcgggagtcctctgggagatagatgggaagaacaatcagggaaagacgtacgacgtcgttgcgaccaagaccgtctacgacggccatgacgcatacatcctggattgcagcggtgatgcggtggtatatctgcccgtgaccggttccgacaccttcctgtaccatgtgaacgacttcggtttcgctaccgtaatccagtccgagatcgtcgagatcgacggggtgaagtacttcaagttctccaccgacgactactcgtacttctacgccggaagcgacccgtaccccgacccgagcaacagcgatgacaacgggaccaactggctcctgatcggaggagcggtggccgcagtcgccatcatcgctctcgccggtgcgtacttcctgcactccaggaaggcggccgcataaacctgacggcccgcctgcaagggcgggcaaacactttttttccgatatccgtataaaccggccgcacctctgccgtcatggagatgatccgatgtccgataagatggataaggcggagaggcgggagctcaaggccaggaacaaggccacgaagctcgataagaagtccaagagtctttacaatcagaagacgttcgtcaacaagcattgacgggaacgaggtccgtcgggggttccccggcgttcccttccttacacggatctcagatgcactcaacttcctggatctctatattttttgatatacgatgggaagtgtattaagactggacggagttgggacgttcagagaagagtgaccattgtgggtgcaacatccattcaggagttaaacggatatgtccatcgttccgtagacgtcgtgctgggtctttctaattacatcctggccgcactaatggtcgccttcggggccgtgcagctgatctatgcatatacggacgagtatacgacgctgacatggcttctcgccctcagctatatcgtgatgctgggcggcggtgcggtcatcatcctggaccgtaaccgcaaccttctccgtgcagtcgggatatatgcgctggcacttggtttttacagattcatattctcttttccgtcgatcgagccggggaatccctacgggatggtcagcatcgtggtctgcgccttggcgatcaatctgatgatctccgggcgttcatatctcaaaggggtaagcaggggccgcaggtttgcgatgataagcacgttccttcttctaatggtgtatgtgacgctgttcatcaccctgatgcatgccgggctgggtctggtggattgcatgaagttgatgcccggggccttcgtaatgtccatcatgtacgccttcttcataggcatcctggattccgaggagttacgctcctccgacatcctggcgatacacaacgataccttggacaagataaggtgtatacagtataccgaccccaggacgtccataccccgtgagacggccctggttttggcgaagatgttcgagaaccggtccgactggcatcctgtggacgacggcggtcccgccgagtgcgaataccggttcgtcatagagaacaagggcaaagggtccgaggtcctcatgcagaaatggaaggggtccgaatccatctatttcaccatctccgactatctggacggtactatactccaagcctacaggttcgaagcggattccgtctgtacggacggcgacccgtcgatatgcagctgggtgcgtatattcgggaagaaaggcgtctgcatgcagctggcggtggacgatcccgagtacgagggggtggggatatgaaggagccgaagatatacgtcggcggtgtacctgtggtcctcatattgggaacggccatgctggtggcgggactgtactacatctatatggaggcagtatcgttcgctcctgaatacaaatcggagctggtgatggcatcttacgccgtggtcctgatgtcaggcatctggatcatataccggcgcgacatggagagccgcaggagcgtctacatctgcggtatggcgctgggtatagccaccatcctgcagaatctgttcttcatgagcgatgatgagtatgggtatgacttcttcctcggtttcttcaccatcctcctgggggtcgccgagatggcattctcggtcgcatatctgttccaatacaggaacgtggtcaataagctcctgatcctgtctggggtacaggtcctgatggtggtcataccgatattcatgaaatggtactcgggcgaacctttggacgatatcatcgtcgactactacaccacgttccccatgatcgccgtacatgtgatctatatgtggatcctgacccgcgaaggcatatgggtgccgtcccccgcgagcaagatagagaagaacctcgtcgcattggaggatatgctgcataccgaccgccatatgtacatgaccccgtcagacctggacgtcttcttggacagtgccagatggaagaacgtgtatgaaggtccggtggagcgcgagaccgccatagagctaagaggggaggaccactcggtccggatgctggtccagaagatgaagggtgacgacgttccccatgctgccgtgttctcgggggatacccgtcagttcgtccaaggattccgcttcgacatggtggacgtcatggtggcggaggaccgcggaagtgtcaaggtatatggttacgacgggatgttcgtcaggatcctggtgagggaccctccggtcaaaaagggcgccagatcccggatgtcggaggccgccgataaagggaagtcctccgaaaacaaaggatctggcacatgcggtcctgaagacctctgaccctttagttctgcatcaggacgtgctgtccttccaccagggggaattcggccaggacatcggagtccagatcggtgcggtgcatatccacccccgttatctggctgtttccataggtcctgtagtagtagatccccttgtcggtgtcgcaacatgacgtgtatatcgtgtattcgtacttctcgtcaccgagatagcaacaccccatctgttgctgtacggagtccattatgtggaagaactgggtcattcccccttcctccgtcccgtcggacagggagttcagcttggtgaacgccgccttgacgaatctggatgcggaggacaggtctcccgggagtcccatggcacccatccccctgctgtaaggcctgaggtcgatgtccttggagaatctgttctccgggacacctgctgacaggttcatgtagttggccagattgtgcatgtggaacgggaacggcgggttgttggtaagtatcccggccgggtcgtcgtagatcgacaggcccgattccatatattccacgacgatggacgactccctgtcggagacgatccaatgaaggggggaggccggcagagcatcgctgaaatcctcatcgatgagattcgtcccggatatcagggccctcgcctcctctaccgtggagcacttgcagagtacccacggtatgaactcgaagggggctatgttgtgggatccttccttcatctccccatagtatgcgttgcctgggaaattgaggccggccatgctcaggccgttctcgttggtggcatcgaagtagagaggacatccatcgaccacggcggccatcccgataagtgccagatgtgtcttctccgcattctcgtgacggtatgcgaactccttgttccggggagtcacgacgaccttctggccgtaggatatctccaggtcgaggttgcgtccgaagtagtggtccttgtccttataggtggctgccatgcacattttccttcctccttgttttagatcccggttatcgttccatgtcggtacgacatccgataatctaacgaagtacgtgttctgtctttataaacgtgacatgtgtgtggccgctgttcgatggaaatatccatacgagtagatgcaaacgacgcggtctttaaacacagaggtggactcgaatcagaagaaacctgataaggaaactagaatggatgcataattggtgcaaccatcgggattcgaacccgagtagcaagcttggaaggcttgaatcctaaccagctagattatggttgcactgaatgacggataaaatgatgatgtatataacggttactctatgctttttattcacgtccagagcattccgatgcacggtccgtacggttgtcaatatcgtgcgcgcataaattatattataaggggggcatgcaccacccatgtatggaaggccggtcttcggaagcaaactggagactgaggattgggaggccgtccagaagatcgactcgtcaaaggacaggctgaaggccctgtcctcggtgatcgacaagatcctcgggaacgacggccaagtgcactctgtcatcctgacagaactcataaaaaaggtagcccaggaggggacctccgactgggagagcgtcgtagaggacctggtgaagaagaagaggccccaggatacgtgcccttcccttgcggctgccgaatgctatgccgtgaagaacgaaggggagaaggcctatcagtacctatccaccatcaaaggcaactccggcgaattcatagtcaccgacgtccccatgttatatgtcgtcaaagccgaggcggacgtcgtattggggaggaagaaggaggccatagaggatctggagacggcccttctctccgatcccataaacgccaaggcctacgagatgctgatggagttggtacctgagaaggattggctcaacatacgtgcctgtgagatgctcgccgccgggaagacgcccgaggaacctcccgacagcggcactcccgagcacgacctgtataggatctaccgtgaatggtacatggggagcagggagacggccacgagtcttctcatcgcatcccgcggatacagggagaaggaccccaggtattgtctcctctccgccaggatgtcgatgtgtgagaaggactggcattccgcacagaacatgtatgaggccgcatgtcagtccatgtcgggaaacgtcgccgtgatctgcgagaccgcagaatcctatgccaaagacggtgagtacgagaaggcgttggcctattacagggatgcagaggcctacgatccggagtctcctagggtcgtgaggggtctgatagacgcctacatgggcatcggcaggaatgcagaggccctgcagatgatgaaggagttcctcgaatccgaactgtccgattacgacgactatgtccacatatcggagtcccagctgaggatgggatacataaacgaggccaagaactccgcctccgtaatcctaataacataccccggggacggtccggcctgcgtcgtcatgtcccgtgcatccgtgtcggaaggagacctgagaggtgcacagctctatgccaaggcgggtcttcagaggaatcacaaggacccggaggtcctcgcccagatgtccagggtatgtctcgccagcaggatgctgaacaaggccatccactacggaaggaaatccgtcaaatacaacagtaactgcataaacggacatctggcactcatggaggcctatcgcgagacgggggataacgagaagaccatggacgtatgccgtgcggtcctcgagctcgatccgcagaataaagaagccgcggacaccctttccaagatcgagttggagcaggctctccgttcgtccacgaacgcatccaacctgatcccggagatatcgggggcggatgatttcatagccctcatatcaggactcctctccgagaagaagtatgccgaggtcatcaaactctgtgccgacaacgataccaagttcgggacccttgcggacgtcagaaggctcagggggaatgcggagtatgcgaaaggagatttcatgaaggcatccgcatcgttcgcctccgccgccgcattgacacccaaggccgagatctggcactccaaaggtatggccgacgaggccttcggagacctggagtctgccgagggagcctacgacaaggccgtcctcatgaacaccaaggagcccagatactggatatccaaggggtgcgtgcaggagaagaaaggcgacaaggcaggagccgtcgaatcgttcaaccatgccatcgaactggatcctaggtcgtcctatgctttggcaaggaaggccgtcatcctcgcggagtctgccagatactccgaggcgctgagcttcatcgacctcgccgaggccacggatcccgacaacgaggggatcatgaagatcaggatgaagatctgcctcgccgccggtaagtacaccgatgccgtgtatatcgggaagaagctcatgaaaaaaggcactcccgacgacgtcgtcgtctgctgcgtggtgcaggctgacataggcataggcgacagtgccagcgccaagaagctggtggagaagtcgcttgccaacaaccccgattccgaacgtctcatggccgccgccagagacctgtacgtctacatgggtgacaacgattccgtaataggggtctgcaggaagctcctcaaaacctccccctatgacaggaagaccaagcgcgcacttgccgacgccctctacaagaccgggaagggagaggaggctacgaccatctattcgtccctcgagaacgaggatgtcaggggaaaggagtccgaaaggaagcctgccgaggccgggtctatgcaggacccggagtccatcatcggcatcgcccgttccctgctgtccgccggtgacatcgtcggggccgggaggatggcggaccgtgccatggccgccgatccggacaatacggactacatcctgttcagagcggccgtgtaccgtaagacgggagatgtaaggatcaccgaggcgttcctgtcccaatgcatactccggaatccgtccaacggggagctctatgaatccgcgggggacctccgtgccgaacagggcgatttcgaaggtgccgtggacgcatacggcaaggccattcagaacgggatgaagaaccagaccctctatgtgaagctgggtaccgtccaggagaacatgggtgccaaggatgcggccatggccagtttcaggacggcccttatgatcgacccgcacgaggcggaggcaggcaggcatctggccaacctgcagatcagggataaggactacgaaggtgccagtaagacgatacgcgactccatagagagccagccgtgcgccgaatcgttcgccattctcgccaggatcgcccagggcatgaaggacagggacggtgtcaacgccgcttatgcgaatttcgtgagatacgacgacgcctccgaggaggactgcaaggccgtcatcaccgccctcaacagcgtcggtctcaggaccgaggccaacaccctcaagtcccgtctctatccggacgaggtgcagaccgaggacgttccgccggaggtcaagaggaatgcggagaggatcatgaggcgtgcctacatgctcggggccgaatgcaacgacccggacgtcctggactccatggggatcgaggccgatgacgccgagaaggccgtcaggtatctcgaggacatccccgattacggggagatcatcgtcgggaccagcgatttcgagaggatggagatcctgtcccacaacgtgatagccagagggaagaacaaggatctggaactgataaccgtcgaggccgcctacgtggccggaggggccagggacgccgacgaggcgaaagtcctcctttcctatatgcagagttgccgcaggtcgaggcttcctagagatattccggagaagtatgtgaagctgagcgaaaacgtatccccgagggacgatatcgaacaggtcatactcgaccagaacgtcggtgtgttcggtgccaggatgataatgtccctggtgaattgaaacgaagacggcgggaatgtcccgcctcttctcatttttatcctttctgacgttttgacaaattccgaaatggatgtttcagtagtcggtcatctccgacttcatgaattctctcatgaggcaggtggcatagttgcctttggggaggaagaacgatacgatatacccgtcggggtccggttcgtacgtcagatccttcacaggacacaggatctccctcctgtccccttccgaactgcagtggggaagtccgggtatgatgaaatcctcggctttcaggcggttgtcttctatgactctcctctcgatctcacccatctcgccctcggcgaactgggaatcgctgccgaacagacatccggtcacgaatgctttgccgagccttacctgtctttccacaaggtcgatgttcttctcggtggccacgatctgctgttcatgcaacgggatcatgtcggcactcatgggtacgaccacatcccctacgaccgggcggttcatcgggagtcctttctctatcctcctgctcagcatgatgttgaaaagatatgactggtaggcatggacgaacatcatctgcagattggtaggcatggcggctatcgcacccgtccaatccccgggattctccgccatgtgctggaccatgaccttctcgaaactcatggaatcggggacggagttcaggagagaagcccagtcgtcgctttcggacaggttcttcctgcattctgcggcttccttgtctctgctttcgtcactggatggcgtgcacacgtagcatttgacggcaccttcgatgtcccctctgacgagcctctcgcctacaaggtgggttatgggcctcatgactccgaatctctggacaccgaaatagttggggaaccctttgttggcctttatgtcggccgcgacctcgccgacgatcgatgcgatctcgtcggccggtctgctgcagccggtgaccctgatcctgaatctgttgcctacaaggtccccgatacgtatgttcctcctggcagtgtagatgtccgagaattccacatccttcagctggaccttctccagttgggatggagggcattcgaacgacatgagctgtgtagtgacggcccgtttgtccttcgttccggcgaatccgatcctttcgcgggacatgcccatctcgcgggcgaaaagacggatcatgcggttcgattcccagttggtggctttgacggtggcgatggtgtatttcccgttctccgctctctcaggacctttggatacctcttccaccacgaaatcctcggccctcgccttgagacggcctcctgtgccgtcggctccgctgaggtagtacagcatgccgatgtccttctcggccgtcgtacactccctgaaggccatctgttcactcggagatggatgagaagtattccccgacggctgcggatgccttcttcagggcttcctcgggggttccgttgcggaccctgacctcgaggtaggggtcgtccaggtcggggtggtcgacgatgtacctgcagtactcgacatcctcgttctggttgagctcctggataaggggttcgatgattgtggtgctgtggttctttaggcccagcctgagggtttttccttccctgctcacaacgtaaatctgcatgtctgctccatcgcgcgttatattataaaggtttgtccggggggtcatcccccctaaaaggtttgtttcgtttaccagaggttctgtaagtgccctttactcggaaccatccaaggggacgcctccgaagagctccggtctcatctctttgacgaggtcgaggcagctgtccctcaacctgccgaagtcgatgaccgggttgcggtacttcttcagtatgtcccagatgaattcatcgatcacgcacttccatacgatcccgaggagttttccctgattcaccttcccgtcggtctcggcgatcttcgcatattccttgttgaccaggtccaaagtcaccacgttctctgcgatgacctcctcgagggtcgtgtccccgtcggaaagtctcctgtgacgctgtttaagtctcatggtgcggaactgggtgttgatcaccttggcccaatacgtctcgccgtatctgttgcggtagccgtacctcttgacgaccaccccttcgccgcagccttgtccctccgttatgtgccagacattatcctcgtcggccatcttctggatgtcgttcccgttgggccggtctatgaccgcaaggggaggtatgtagtccaccccatagtcgtctagaagtctggagtagatgtcgtacgggatgtagtattccccttcgcaggtgaggatctcgcctgtctgggtcatatgttcgagatgcttgttttcggagcatacctcgaagacgaaccaatgttcccatgtatccgcagtatagctcctcaccgcatggggtgtcatccactccccatacagtcttatcccgggattctccttcaggattcttccgatctccggatgtcccttcacatacctggtgaacggatgatctccgtccaggatacagttcctgctcatacagcggatctctccgtcctccgtgtacgcacacatattggagccgtccatcttcgggaagatgtagcagaccccgtccgtgagtccttccgtctcgtccgcaccgaaatgctggacgtgctggtattttatgaatgtcatatctcattctcctttgttttccgtattttctcaaaaacctcctttccgtacggttccggataccgtctggaaaaacccgtgcgcgatgcgtgacgctgtctatgacaggtgttacaaagcggcatgggccataggacgactcgcgacatcatccgttgttgtgaccggacaagctctggaatacgccggaccgaagaatgccgtcgcctgctaccgctggtcttgtgcagcgggcagtatgcgatgagtggtccggacgcgttgctttcatatccgatcggaaggtgtgagaagaaggtcgtataaaaacaaatggtgacagggatttcgggcctgatttgtctactgtatgtattttcagccttactggtatcagttcttttcgattacctttatctacagtggttatgatatggattataaatccatttggtgataagatggttgcattcaacatgaaaagcattgccgtcctgaccgccgccctgatggtctgttccatctccgcggtggctctggtcgacaacgatgattcctcggccgatgccggtaagggatacgagttctatgtccaactgaacgacggtaccaacagttattccagctggctcggggtacattccggagacagtttcggcaccgcactcaaggatgctttcgacaaagccggattcatatactccatgtccggcaactggatctcctcgatcacggtcgatggagtcgaatactcctccggagagtggggtaccgatccctactacggatacgccatatactattccgacggagtgaaatgggtccctacggaagaatacaatgaaggcagtatgtttgcgatcgtgttcgacaagtatctgttctccgcacctgagaatccagatatatactacaacaactacaactattactattcccttcttccgtccgtccctgtatgcagcgagtggtgcttcaacctccagctgaacaacggtaccgacagcatcaacacgtggatcccctcccaggatgccaaggaactcacctccgaggccttcgccgccgctctgaagtccgcactcgatgtcaggggattcacttatgacatcaccgagaccggttgggtcaagtccataaccgcaaacggtgtggagtacaaggtcagcggcacgttccctacggatccgtactacggattcgccatctattacgcccagggcgagaaatgggttccgaccaacaactactccgagagcaccgtgttctccatcgtgctcgaccagtaccagttctccgctcccgcagaggccgacaaatattacgacgggggatggggctactattccctcctcccgaccgcagccaccagctcatacacatccgctatcgtggagccttccgatgacgtggacaacatgttcatctatgtcgccgccgccatacttgcggtgctcgccatcgggataatcgtgttcgccctcaggaaggcaggctgctcctgaagggatgaccttttttaaaccacttaccggacaccggaaacgggtccgggtcttcattctacatcgccgttgtcacggtcttcctgcatacggtagaattctacgatctccgaggcggtggtgcattgctccggggtcttgtcgtccctcacccttccggtaaaccgtgggaagcggagccctagtcctgcgtcctccttaacagtcccgtaggctatggtgtgtatggggctcaggctgatgtccgcagccgtcacctccaggacgaccccggggatgaaccatacgtccgggaccatctccgcatccagggatgcgggcttcgtctcgcacctgtacttctccagaaggccgggcatggcgtcgaggaaggcatcgtcgaaacccgttcccagcttgcatgcggtaccgaaccttccggtgtccgggtcgtatgcggccatcagcagggcgccgtatttcccggcgcgtttgcccatgccgtagaacgcccctactaccgtcagatcgaaagaatccacgagtgcctgggtgtagtccttcttgtatttgatccagaggaatcctctcgaccccgcccggtataccgaatcctcggacagggatttcgccattatcccttcgcatctggccgctatggccccgtcgaagaacttctgggccttctcgtccgaatcgattatggccctggaggtatacccaatacggtcgtatctttcggagtcgtcgtctttgaaggacgattcgagcctcatcctgcggaaggagtacggtttcagggtatagtcctcgccgttgcagtagagcatgtcgaaaaggaatatgcggacggggatgtcctccaccgccttctccatgccgtgtttcttacgccggtgggtcacgttctggaaaggttggagggtcccggtgtccggatcgtatgctacacactcgccctcgactattgcctccctccccttcagctgtctcagaagagcttcccctatgtccgggaaattggaggtgaggtcctccagacgccttgagaacagctttacgaatccccccggccccttctttatgtgggcctgtaccctgatgccgtcgtatttgtactcgaacgcgcacttgccgcccaatctttccattatttccgggagggagcggaggcgttctgcgagcatcaccttcaccgggttcccgacggagacctctatccccttcacggcatcaagacctccggatgcgagggtctccgccaccaatcccatatcgcacgttatgttgaacgccctctctatatcggggcgatcctccttggaggcgaatgccgaggcgagtgcatccattgcggtcatggttccggcgccgactctcatcctgccggtgactatcctgcagaggtatctggcttccaggggcgacgagtcgtggagcatacgtgccagcagtttcattttcttgtcctgggagtccttgcccgatgcgttctctatggccgtgaggccttcgatgacgttttggaacgacaggggttcggagaacagggtcatctgtttcttcttggcaatgagcatctcggcgacctcaccggggtcgccggtcttcgtccacaggtcctcgacctcctccgaccttctcccggatacggatgcgatcgccttcagtaccagtttgtcggccatgcccagttccagagggacgaagtccgggtggagtctcccgaccgagaggtatatggtctttctgatctcctcaggcttcacatttctgaagaattcggccagtatgtccgtcatctccagacggctgctggttttctccaacctgtcgaatacttccgcaagatccccgaactgcatcatcccatcccctgaagatcaatagatgtctatctcagtctgtctcctatcgaccgggcgtttcttctggaggtcgcggcttagggtctccaacctctgcctcatgagggcctccttcttcttgctggcactttcgacaacctcgtccatcgtacctgccgcgatgaggacatagacctccccgtcgttcttccttccggtacggcctctcctctggatcgtcctgatctcggaggacacgggctcgtagaatatcacggcgttcgtgcttgttatgtccaatccctcctcccctacggaggtcgacaccacgacgttgaaatctccgctgcggaactggtccagcatctcgatctgatctttctgtttcagtccgccgttggcctgccctatgagtttggtgactttagcattctccacatgagacaatttctccaccaggatgtcgcatgtctccctgtattgggcgaataccaggatcttggagctctcccccgagttgaggactctgcttaccaggctcattatgcgagacaccttgggatgctccacatccgaggatccgattatgtgccagatctgtttgtattcctctcttttgacgagctccctgtcggccttgggacctttcgggtcctctccgctctcgttgatcttggagaggaatgcgcggaggggggacatcccctgggtctccgccaactcaatggcgtacaggagtttgatgcacatggaggtcaggctgagtccgcggaacaacgtcatgctcttctctccgttgcgcagtctcatctgcagagacccctgtatcgtcagcatgtgttttttagatgcaggccagttcggattggtgaggtgaagggccgaaaggtctccgaaatccttgtagagcatcttgcggaggaggtccgatatgtcggtgaggtccttgggaaggttcaccactatgcgattcacatatgtgtcgtggacataaggtgagacgtctgggtcatcgtcggaacggacatctatgcgggtcaatccaaggttcccgcatacctcctcgatcttcttcaggtcgcttcccggcgaggcggtcatccccatggagacggcatcttcggggacatatcctgcgacgttcacatagtcgtagttgccggtgcctctgtgggcctcgtcataaatgacgaggccgaaatccgagagatcgtatacgccgttgtcgaggtcgttggaaacggattggggtgtggagacgacgaggtccgagtcttccaagatcgccttcctcttcttcggctgcatgtgtccgttgaccatcccgacccgggtctccggcagcatggatgagaagtactcgctgtgctggtccaccaagggtttggtaggtgccagcatcaggacttttttccctttgtgcaggattcttgcggccaccagcagggctacggcagtcttacccagacctgtagggagtatgacgagtgtgttctcccctaggcatcccgatgctatcgctgattggtatcttctcttctccaatctgtctggggcgattccagggacgtcgacatagtccattatgccacttcaatatctgggtcatttaaaagggttgtcgaggggtgaccgattctgagggataatgtaaacaccgccctattaaaaacaggcgggcccgaaggcccgaattggttgtgcgctcagcgtgaacggaatctatagggtgaaagtcccgaacaggctttgcagtcggaactgtagcttaatccaagggtgtcatccgcgaggatggatctgaaggaaggaggaggcaaaaccgcgagtcgatgaacaagaaccacatggtaggcgtcaggacatggacgagtccccgactatgattaagtcccagactgcacggattgtcctggtgtaaatgtggcggctgcatgcggtgaaagatttcgttagtacctggggaggtctcgcatccaggcccctccgtcggagggacaacacattccgcgagggatgtctgaggattcgagaagtcagcagaggccacagtactcccagagaatgttcggaggaaggttcgggaaggaagggccgaatcaaaccaagtgtccagaatcgaaggaaggtcggatatgtgcgtaaatcagaaaacaacggaaagctgcccgggaaagaacaggtcggaaaccgaaggtatcccgggagcgaacagcatacccgatacggattatccaacaaggtcctgaaaggcctgggcatgtatttcattcaaggaaatgtagagaaatggtttgaaaccgccgagtaccgaccggtacgctcggtggtgtgagaggtccggttgggcaatagcccaactgtcctactcgattgatctcagtaggatccgcatccgccgccgcaggatgcgcaaccgttgaagttggggttgcggatggagagaccggttccgaagttggggtcgtccacgaactcgatgacacagtcctgcagtgccttctcggtctcctcgtcatagaacatcgcaaagctggatgcgctgttgtccaccttctccccctctgctgccttctcctggaaggacatgccgaactggggtccggagcacgcgtatccggagaggtacaccttgatgccccatccggtcttctggttcttctcgagaagctcgtctatgaacttctccgcgtcagcggtgattgtgaccatggtgtatagttagtatgttgtactataaaaagtataggtatacctaaattccaacatcctcaggtcattccaactttctgccgaactgctccgcataggcgcggaacgagtacgactgactccgggtcatccccatgtaggctgcgatcacgaggacctcgaggacctcctcctcggtggcacccaaggcgacggactccctcatctggttcctgatgcagtgttcgctccccatcgcggcggcggccgcaagtgccagcaggtgttttgtcttcttgtcgaacttggtctcgttctcgaatatcgccccgctgagggacgagtagggtatgaacaggtccggacgttcggagaggatctggttcgtcacggggatgaatccgcagaccttcctcaccctttccaatatcttttcgacggtcttctcgtcttcttccttcgtcatcgggacatggaatcggttcatccgtcttaatcgtttaccggtgtctgcggacttatgacttttttgaacaattgtaaaccacgcagggcgcgcacgtctgctggccagatcgtcggatgatagtatttgatgaaggttaatctgatattggatgtataatccgaattgtacttatactgagaacgggattattccgccagtcaagtactcgcaagaggaaatatcggatgcgttcgtaacggagcatggaccccatggtggataactcctggatacacgaaaagaggccttccggcagatccggatggcaatccaagatgatgaagacgaaagtcttcatgacggtggccgtcatccttgcaggtaccatcctggccgtatcgctgaacggtctcgggtccaacgccaccctctatcagtccgagggggtcgtcgtcgatttcggaggatacaagacctcttggactgatgtggattacaaggagatcgacgacccggtggaacttctcgtcaaggcctcggagaagcacgggtatacatacaccatgggggaggacggtaagctggagtccgtatacgacggatccgcgacgtattccaacgaccccacccactcctggggcctgtggtatgtggagaagaagagcacatccttcaccaggtcggaaggatacggcataaaggcctccgattacaccgtgacggtgtgggcctatacggagaaggatgcggaacctgccgtggccgtggatgccaccggtacatccatctacggatactcccagccctccagcatggtgaccctctcacccgtatgtacggagatcgtcgcgtcgatgaatgcggtctccctcatcgtcggtaccgacagctacagcaactatccgtcgtccgtggtcgcaggtcgcgacaacggttccatcgccgtcgtggggacatatacggatccgagctacgagtccataatgcacaggggtcccgatatggtgatctgcgacggttcccaatacaatcaggtacaggtcgcgaagaccctgcgcaactccgaggtaaactcggtcgtactttacaatgcggaggatgagaaatccatcatcgacaacatcttcataacgggagtcgccatgaactacgggatgcgtgccctggatgtcatagaaagcatgacctatgcgatgaacgccataaggtccgcggtctcgggaggggccggtacctcggttatggtgacgctcaataccgacgcatcgcccactgtcgcagggtcgtacacgtacgtgagcgatatgctgtcctccctgaacgggaacaatgtggcatcggagatgaacggatgggcgcacctcacgtcggaatacgtgaccaaatacaacccgtcgtgcatagtgatcctggattccggcacatactcctccggtgattacggcaggatgctggccaatctctctccggagtggaagaatacggacgcgtacaagaatggcaacatatacctcctctgcgaggatatcggggaactgtcccagagggcgtcccctcgttccgtccagttcttcgagatcctcgcaaggatcctgaatcccgattccttcccggacgggatcgtcgttcccaagaccatcgggaacgattacgtatcgtatctgacctacaccaaggacctgggtttcggtgattgacatgacgaggaaaggtacattcgtatgtctgttcgccgtggcggtccttttgttctcggccgtcccggcatccctctcgtcgggtgctccggaagacggtacgtacgccggggacctcctgatcgactatggtaacggaaacaccgactgggtggccgtgagtgcaggggccacggtgggcgatactgtggcgtcctcgctcacggccgccggagtggaatgcaccctgtcgggaacagtcctctccgtggccggaaagacctcgtcgaccgtaggggccgcggattccggaggttctttgtcctcaaagggtaccacaggtgtcaccgtcaccagcacctggcacgtcttcctgtgggatcgggcggcgtcgaaatggtcggaggcgtccgacctgtccgcctcatactccggagggccgctcgccgtcgcattctatcccgacggcatcgtcccggtggagactccggaccacaggtcctcctggaccatggtggaggccgatgcggagaactccgccaaccagaccgcggacctgtcgggcggttccggcagcgtggaatggagcaatttccccaaggacataatcggcgattattccgccatcctctatgccgacgggcatgccatcgtcaagtacggatatcccaaggacggcagccgtaccgcatcggtgatttcgcataatgcggagacgggggaggtggaatggaggttcgactactcctgcaccatgtacgagactaccagctgtctcatcgtcggacagtacatctacataccttcgacgaacgggcacatctaccgtttcgaatgggcggtcggtccgggagaggggaattccaacgtaaccacgttcgacgggatgccctgggattctccgaccatcattccgaacgagaccgatcacgacgtcatgggcagaccctacggggagggtgcgtcatccatggtgtgcgattcgggggccatctatgtcaaggcatacaacgggatgctgtactgtttcgacctggacctgagactcgtatggtcgtatcagatgggcggaaggacgtatttcaccgccccgaccgtgacggacgactatgtggcggccggtgcatacgacggcacgatgtacatcctgaataagtacgacgggtcccttatatgcaaagagctcgtgtatcggacggtcataaaggatacgccgtacggggcggtgaacacccctgtgttcgtcaggaccggttcctcgtatgcggtcttcaccacatataccgacggacgcggtatgaacacggtcacgagcggggtcgcggtctacagtttcgacgggacctccctgacattcgtggaggacataagatccgacgagatagggtccataacaagttatctgacacgttatgtcggcgatgggttctcgggggtcatagtcgcagcgtataacggggtgtacaaggtcggtacggacggaagccgtgagtgtatcaacacatatctgtccaagacgtattgcacccattccgcccctacgttggtgaacggcaagaccctgtatttcataacgtacagcaagtcgatcctcttctctatgaccgtggaggggaaggtcgtcggttctgcggaatcccctctcaagaaacagttcagcatggcccccgtcgtcgtggtcgacggtcgcgtgttggccgggaacgacacaggtgtgttcacggtgtccggggaccttcctccctacaccgtcgaggagtaccatgccgagacgcctctctgggagaaggccgcattgcttatcgccgtcatcctcgtcatactcgccgccctgtgggccgtcatgagatacggtctgaagtgggagcatccctaccgcgagctacatgaccgcatattctgctatttcttcggggagaactacacccacaataccaagagcaagcgtaagctgcgtctagtcgtggccgtcgggatcatactgacgtccgtggtggcgttggcgtccctgtgcatcgggtccgagactacgatgggtgtaggggaggccctgtcggccgccgtgtccgccatacagaagggaggacacagcctcacctacgaggagatgctcatctataacgagaggctgccccgtgtcatcgcggcgttcgccgtaggaataggtctctccgtggcaggcgccgtctatcaggcggtcatcaagaatccgctggtggagccttacatcatgggtgtgtcctcaggagctggcacattcgcagtggcggtcataacgttcggattcacgttcttcgggttcttctctgccgggagtacatatcttacagccgcttccgccatagtgggagggctcctggccttcggatgcaccatgcttctggccgagaagaccggcgggaaatcaataaactacgtcctggccggtatagtggtcgggctggtgttctcggcgctgcagtccctgatgatggtggaggccggtaacaaggtctccagcgccctctcgtggctgtacggatcgttcgccaacatggggtgggacaacctgtggctggtcctgataccgtgtctggcactttccatggtgcctttgatatgggcaaaggagctgaacctcgtcctcctgggggaggaccaggcgaggcagatgggtctggacgccaagaggttcgacaggataatgctgatcctggcctccgtcctcaccgcgttctgtgtcgcattctgcggtgtaatcggattcgtgggtcttgtgatcccccacctcagcaggatgatcatgggaggggaccacaggctcatgctcccgacggccatggccttcggagggttcctgatgatagcggccgacctcctctcgagaatcctcatgaccggttacgagctccctgtcggggcgataaccactataatcggcgtacccatgttcgcatatctgcttgtcagaagggggaagagctatgatgcctgatccggacgggttgcgcgggaaggccaggcgccttatggacggggattcccgtaagcatatcgacatcaagagacacagagccagattcatactttgcgccggcatcgtcatactgttcgcgatgttcctcctgtcgatatccgtaggacctacgggcgtacagaaccctgtcgaagcccttatgaacctctggtccgccatatccaagggaggggagggcctgaccccggaggagctggcggtctacagctcccgtctgccgaggaccgtcgccgccataggggtgggggtgggtctcgccgtggcagggtccgcataccaggcggtcatacgcaaccccttggtagacccatacataatgggggtgtcctcgggggccggtacgatggccgtggcggtcatcgctttcgatttcacgttcttcggactgttctcccctcattccatatatctgaccgcggcgtccgccatagtcgggggccttgtggcgttcggcaccaccatgttgctggcacagcgtgccggaggcaccaccaactcgtacgtcctgtcgggggtggtggtaggcttggtcttctccgcggtgcagacggtgatgatcgtgttctcgggggacaggatatccagcgccctcatgtggctgttcggttcgttcgccagcatatctttggtcgaggcgttttccgtactgatcccggcgttggtcctgtcaattatcgtactgaggtatgcgaaggagctcaatctggtgctcctcggcgaggatcaggcgaggcagatgggtctcgacgtcaggaggttcaacgccctcatcctcatcctggcatccgtgctggcctcggtatgtgtggcgttcgtcggtataatcgggttcgtcggactcgtcatccctcacttctgccgtatgctgttcggaggggaccacaggctcgtcctgccggcatccatggccttcggcggctgtctgatgatattcgccgacctgctgtccaggatgatagttttaggtatagagctcccggtgggagcgataacgaccctgattggggtacctgtgttcgcatatctgctgatcaggaaagggaggatctacaatgggtgaaacgcctctgttggaagttcgtcatttggataagaagtatgataacggtttccatgccgacaaggacatatcgttcactctgccgtccggtctcctggtcggtctgatagggccgaacggctgcgggaagaccacgatgatgcgttgcatcaacaagatgcatcagcccactggaggggacatactgatagacggggagtcggtcctccccaagacccctgccgaggtggcccggctggtctccaacgttccggcggagatgacggcgtccttcggtctcaccgtcttcgagacggtcatgctaggtaggtatccgtacctgcagaatatgtggtgggagacagaggaggacgagtcgatggtggaggagaccctccgcaagttcgggatcctccatctccaggaccgtcctctgaatatgctctcgtccggagagaggcagagggtcctgatcgccaaggcgtatgtgcagaatccccgtctgatgctcgtggacgaaccgacgtcccatctggatatgaagtataagctggacgtcatggagtatctgcgtgccatggtgaaacaggatatgaccatcctcgtggcggagcatgacatctccctcatggctaggtactgcgatcggtgtataataatgaagaaaggggagatcgtagccatgggcgaccctaagaaggtcataaccgaggaactcatccgcgacgtgtacgaggtggaggcgtccgtcggtaccgacaaggacggcgagatctatgtcctccccaagaggttcgtcggggaataccatctctgatccgggagttagtgctaactgtagcaatcgtctttaaaatcccttctctgcgaactcctttctgcgtaaaacgcggagaggtaagatggaaaacaacaatagcggagaacacaagaccaacgacgacaggctgaccgacatcttctccagtgtcgggagacaatataggctgaccgacgtgacggcgcagttcgtcgccttcagggacctgaagataaggtggcagaggtcgtacaagatggcggacttcatggtctccgattatctggacgacgctcccgacgggatcctttgggattttgccgatacgataatcgccaagatattcgcggagaacgattcagattattcgaattccgtcatcgaatggatctcgtcggacggtttccgtgcgcgcaaacagccgatatatctgcgtcggagcaagaatctgacgaggtccccggtgggcagggagaagaaccttctggattcctacggccgtctggtcgacgacggtctggttgaagaggaccccggactgtgcatatcgtggatgaagagcgccacggccaggaagataggccactgcagcgtcgtgatggacgtcgtggccctctcgggggccttggacgatgcacatgttccggatttcgtcctggactactgcctctaccacgaactctgtcatgtgaagataggcttcgacccgtcgggaaggggacatgaccagaagttcgccggactagaggatatgtatccgagaaggtccgaggcggtggagtggctcagacgcgtggatatgttcgtctgaagaagatgtctcccgaacgctaacacgccctttcacagtccggcgatgacgccggcctcggagcactgacgtacgccgggagtatgtgtcggaccctgcgttggcctccggtcactgccgcgacgacgcgtcgctgctaccgcaggagccctaatgaattagggacagggccgctgtacgccgttccgtacctatggcggtcacgtatcgcgcccattggtcggaacggtactgctgggagccggacaagggtattttagcgtttcgggtatacgtttatcgtcgattttttagtacgattattgtctttaacttcgtcaaacgatgaatttcatacgatttatattagtttaattacgaaaaacatgaatttcacatagtattcgaatgtaattctacgaatttcatattcacagtggttagatttattaaagggaagtatatatcgcactcccatgttggaattcttcagccccaaatccgtagctatcatcggcgcttccaacgacgtgaccaagctcggtgggatgctcgtcaagaacatgcttgatgcaggatacaaaggaaaactctgtccgatcaacccgaaaggcggggagatacagggactcaaggcgtacactaacgtgaaggagatcggggaacccgtcgatctcgcagtcgtcgtcgtcaagaacaccctcgtcctccagaccgtcagggactgtgcggaggcaggtatccaccatatgagcatcctttccgccggtttcaaggaggacagccccgagggagcggagatggagaaggagatcgtcgccgaggcgaagaagctcggtgtcaggatctgcggacccaactgtttcggaggaatgaacatcaggagtggtgtgaactacaccttctcccacctgcttccccaggccgggaacatctccatcatgtcccagtccggtgccgtcggatcctccatactcgactggtcctgtgccaacggtgtaggtcttgccaacttcgtcaccttcggtaacaagtgcgacctcgacgagggcgacttcctgagatatttctccgaggaccccaacaccaaggtcatcggaatgtactgcgagggcatctccaacggagagaagttcatccaggccgtcgagagcatgccggtgaaaaagcccatcgtcatcttcaagtccggaaagaccgaggccggttccaaggccgcatcctcccataccggttccatcgccggttccgatgccgtcaacaacgtcatcttcaagaaactcaacatccacagggcattcgacctcgacgagatgttcgacgccctcctggtgttctcctgctgcagccccatgaagaaggacgggctcgggatcatcaccaatgccggaggactcggggtcatgtccgccgacgccgcctacaacgccaagtacgtggaggccgccaagctcgcacccgagaccatcgccgacctcaaggcaggacttcccaagctcgccggtatcaccaaccccatcgacatcaggggagacgccgccgcccaggatttcaagactgccatcaacgccgtcatgaaggacaaatccgtaggaggactcgtcatcatgggttccccgcttgataccgcggacctcgtcgccgtcgccaatctgctggtcagcatcatggacgacatcccctatccgaccactgtctgcttcgccggaggcaagaagtgtgccgaggccgatgcgatcctcaagaaaggtaagttcccctgctaccccacccccgacagggccgtccgcgccttggacatcctcaggcagtacaacatcggcctcgagaagaccaatgccgcactcgaagtacccaaggtcgacgggcgcgggaaggtcaaggccatcatcgatgccgcctacagcgagggccgccactccctgaccgaggccgagggtaaacagatcttcaacgcctacggcatccccatccccggagaggccaccgtgaactccgcagaggaggccatggccgcctgcgacaggatcggatatcccgtcgtcatgaagatcgtctcccccgacatcgcccacaagaccgacgtcggcggtgtggtcgtcggagtgaaggactccgccgcagccaaggctgcctacgagcagatcatggccaactgcaagaagaacaagcccgaggcgaggcttgacggagtatccgtccagcagatggtatccggacaggaggtcatcctctccatgatgagggatgcccagttcggacccgtcgtgtccttcggactcggaggtatctatgtcgagatcctcagggagatctcccagatgcacgtccccatgtccgagcagcagctggaggagatgatcacctccaccaaggcatacaagctcctgtccggggccaggggaatgcccgcatccgatatagatgccatcaaggacgtcatcaagaggatcgtcctcatcgcccaggagaacccggagatcaccgagctggagatcaacccggtcctcgtcgggaagaagggtcagggctgctgggcagtggactgcctgtgcaccctcaagcactgataaacgtcttccggccccttcgggggccggtccctttttggaatatattttaagcggtccgccatatcggtggccatgacatccgagctcgtattcgtgggactcggcctgagcggcgtcgacgggatgaccgtcaaggccctcaacgctctgaaggaatgtgacaagatctatgcggagttctatacctccaatctcatcgggaccgaggtatccgacctcgccgagttcataggcaaggagatacacgtcgtataccgctccgaggtggaggagggtcacgacatcatcgaggacgccaagaccatgcgcgtggcgttcgtgaccgcaggggatacgatgctcgccacgacccatgtagacctgaggatacaggcggtcatggaggggatccccgtcagggtcttcaacgggatctccatcttcagcgcctgtcccacctgtctcgggctccagccttataagttcggaaggaccgtcacccttccgttcctggagaggaactaccagccaaagtccccctacgaccacatcatggagaacaagaagcgcggactccatacgatgatccttctggacatcagggccgaggagctcagatacatgaccgcgaaagatgccatagagtggcttctcgcgggcgaggagaagtggggggagggcctcatcaccgacaagaccctcctttgcgtggtatcccatgccggggccgaggacgagaaggtcgtcgccggatatcccagggaccttctgcagatggacctcggcgctccgttgcagaccctcgtccttcccggagagctccacttcatggaggcggaggcactcgtggacttcgccggggctccggaagagatcatacaggatgatgagtgatggcgaagtgcatccgcgtccccaagtcggagggggaacccatcaggcgtgccctcatggaggaagggcttctcgatatggactaccgtatagggtcggaaggcgacagcatactgatgccggtgctttgcgacgggtatcgcggatatgctgccgaggaggccgaactgaggccttccaaccgcggagagaccgattacaaggacatagcggacgtcccggacggattgaaggagtacctccccaagtcattcgacgtcataggggacatagccatactgaaattggaggattgtctggtcccttacagggccgccataggcgaagccctgatgaaagtcacccccaacatacgcgccgtcttcctggacggcggtgtgaagggggatttcagggtccgtgaactggagaagatcgccggttccggtacctccgaggtcatacaccgggaatacgggacgcgtatgatgacggacccgtccaaggtatacttcaatccgcgtctcgctacggagagggcccgggtagcctcgatggtagaggacggggaggtcgtcatcgacatgttcgccggggtggcaccgttcggcacggtcatatgcaggcatgcgagaccgtccatggtgtactccatagacctgaatccggaatgcgagaggttcatgaaggagaacatgcgcctcaaccatatccgcaacatggaatgcatcatcggtgattccaccgaggtcgtcaggaaactgcccaaggccgaccgcatcataatgaacctgccgcagatggctgacaggttcctggattccgctctgcgctcggtgaaaccgtccggcatcatacatatgcacaagataatggagcgttccgaactggaaccgttccagaaggagatggcgaagaggatggcggacgagggcctcgggatgagggtcgtccgcgtctcggaactgaagacgtattcgcccacgatgagcgtatacgtcttcgacatatgtcccgagtgattcacttcttgttcacgggggcgagggtcacaccggtctgtccctgatagtggccgctgcgcttctcgtaactcttctcggaggctgaggtcatggtctggaagaccagctgacaatacctctccccgatcggtatctccagttctttgtcggagctgttgtaggatccgagggtgagcgtcccttcgaatccggcgtcgaccatgccgaatgcggagatcgttcctttccttatccacgacgtcctcagccagaggttgccgcagacatcgtcggccatcctgaccctctcgatggtggagacgaagaacatggtcttcgggggtaccttgaccgtcccctcgttgtagaccttcccgtctatggagatctccgccaccctgaggtcgtaaccgttgggagtgagacttctctcgttgtagtcgctgatgcctatgcgtccgctctggatgccgtataggatgtccctgtcggataggattgccatggcaggttatcgccatggggataataaaccctatcagcggaatctctgacggtccgctatcgtgttcaggacgccgtccaagagtctcatggtgcccccgagtccgatggccggttccgcccgtacgttcacggtcttgtctcccgggccctcgatatccacatgtcccagcgcagtacctttcgatatcgcggatgaacagatggcgcctccggcgatgatgacgtccgtttcggtgtgcagagcatcgtccgataaggggatccccttggatccgaaaaacgagaatgtctcatccttccaacgttccccattcggacatgtcacggccacggggatcataccaaggtatctgtagaggaatctcgagacggcgtatgcggtggatccgtcgcagtagagggagaacgtacgtcccttaggcagcaggtggcaggactccatggtccttatgcatccggccgcccttctcctgcatacctttatctcctccagtgccgcggtaggatctcttttcatgatctggcacaatgagatcacccaatcctcgagggcatcgaatccaatgggtgccccttcccggggtcttacggtttggattccgtactccctttcatagaagtttgccaccctgtcgccgtactccggatagaccaggatgttggcttcggcctccgcggacctcctgatgtcctccgccgtccatccggcaccgatcacgcagtttatccctatgccgcatagtgccaacaggttcctcaggtcttccaccgtgtcattccagttgaggtggaggatggagatcccgaccaggttgacggtccctttcctcggggccttccttttcggccttatcctgtcgacaagtgccaggactgcatcctggaatccgtcggagcatgttccggaatagtcggcatggtctatgcataccgtagggatcctgtggccgacggaaccgatgtcttcgccgatgagggatgcccccggcgaattcactatgcctataacggacggccccatcttctcgacttttgcatacaggtcctccagtctgtcttttccgccggtgacgaacttccccatgtcgaggtatgtgcacgggaccctgggctggctgaagaaatatctgctgcccatctcgaacaggttcctcgatacagtccctcccttcctcgtcctgtagcacgattccgatacggaggaaggatagtatttgcatccggtcgggccgtgtattatagtatatccgtcggccactccttccaggccggctatcagccccagaaggctttccggtctctcgttgtcaagcgacatccttcctccaaccctcctccttaggtgccagcatccctcttatccagtcgtccgtgagtcctctggccgcgaaagtgtccgtcgaaggggcgcacggcagacgggactggtatatggacgggtccacatccgcaatcgcagggaccagaagtatgtccggatgggacgaatttatagtccgcatcacatccggcacatcgttttcatatatggccgtgaatccgtccggcatcctttcgtcggtcaggtcgtccgtatggtccgagcggctgagtatgtatgcgccttttatttccaggcccgcaccctccaccgcctccacgatccacgagatgtcgttgtttatggcgactatgcagcaggtctttcccgagaggatccttctggggccatccatcatgcggtcgaacctttccctcatcccatctatgatcatgtccgctttctcttcgcatccgaagaaccttgctacgcaacgtacccatctggatgtaccctctattcctccgcgcacaggttcctccagggtcttcatgccgtatctgtcctccaggaaacggcatatcttgtcggagaagacgtccgggttgagcttcaggttgacggtcgcacgggaggcaccttccagccccttcatgtcggtgatcccggggaggatgcagttcaccgttatcccgagggacgacagtatggatgatacatgtgccagctccgactgcatgttgctggacatcgtcttcgatccgacgaggttcacggaaaacggtatcgtttcgcccggggacgagaatctttctaccagacctatgcccgcgtctatgactccctgcatgaagtctccggtggcgttcccgtcctccttgaggatgcatatgcgggtccccggattgttcatttccaccttgcccactatgcctggcacatcgtcccctatgatccccggggggcatgcggttatgacggcgatatccttctttccggcggctacgcatttcccgaggacatgctcgagggcctttccgcctccgaagatcatgtcatgctccttcatgtcggtgcagatcacgtcggggtcttcgaacgcctttaccacccggtatccgcgacgcatcgcgccgttcacgctgttggagtccaattggatggtgaaatgggcacagctcttcggggagtggaggacggtggtcagaccatctatcgatgtgcagacggatgatgccccgctgaaggcgcagccgttcagcggttcgtcgtactcggcgatcctggaggagtagggcctaggtctccggctcccggtattcgattggacggaggccggtgcggccttttccgggacggaggtccttccgagtatcgtcctttccagttcgtcttcggaaaggaatctcgcacgatatctccttccttccaacaccttttgggccaggcccctgaatgacgacgcctcgggtgagtccggtctcatctccacgacggtcttcccctgtttctcggcctccatgaatatgggcgacctgccgaatacggctatcacggggacacctaccgcttcggagaaggcctttacgcgaccgtcctctgccgggtcccccctgctgttgaatatcaatcctccgatcctgtcggggtcgtagttggccgtacctctcaggatgttgttggcggcatagattgacatgaactccccggatgtcactatgtagaccgtgtccgcatatccgttcctcagagggactgcgaaacctccgcatacgacatccccgagaacatcgaaaagggtgatgtccgtatccacggattccgcccccaggtcatccaggaggtcgaatgcggatattatcccccttccggcgcatcctacgcccggttcgggccctccggcctcgacgcagagacatcccctgtatccagtggccatgacgtcctccaatctccggtcctcgggtttcacggtcttcaggtattcgaggacggtgttctgggacctgccgcctatcaaccctctggtggaatcgtgtttggggtcgcatcccacctgcatgacctttacgcccatgtcgccgagggccgctgttagattggacgataccgtggacttgccgataccgccttttccgtatatcgctatcttcctgcccattggatcgaccgtagaaacataccgggaaaatcccatgtatcgatgtaaattatatccaatgtatttaaatcataatcttcgtagtatattacatcccacttacattaatattcgataaattcattctggatatttgtaaaacagggagagggcgagatggctgtaatatccaccggtgcgggtcgtattttccaatccaacagaagattattatccgttatggatatggggagacgataaaatgcgcatcgtaccgaggaacgagctcagagacctgccgaagacggtccacggagggcagggatggaggctcacaggggtggaggacttcagtcagaacctcaatcctctcggacccccgcccgagttgaaggacgagatcctcaatgcggtctccgagatcgggcattatccggatgcctccaacgaggtgcccaaaaaggcggtcgcagactacttcggtctggacatcgacaatgtggccatgggtgccggctcgtccgagataatcaggaatttcccggccgccttcatggtgccgggggacagggccctcatgatgcgcccttcgttcgcggagtacgcccagcagtgcaggatagccggcgcatccatagatttcatggacctcatgccggaagacgatttccgtatcgattcggaacggctgtcccagatggtccgcgacaaccactacaaggccgtctacatatgcaatcccaataatccgacgggacgcatcgagaagagggagaaggtcttggatatcgtcaaggagtgcgaggaccttgggaccatggtcttcttagacgagacccttctgggtctttccccggaagccgccagcacatcccttaccaagtatgtggggaagttctccaacctcctcatcgcggattccttgaccaaatcattcgccattccggggatgaggatcggattcggcctctccagtccggagatcatctcggagctggagaaggtccagcttccctggaacctaggtacgttggaacaggccgtcgccgcctatcttatggagtaccgtatggactatccagatgtcgtggcccgggagctcagggccgagtcggcctatatgcattcccgcttggacgacatcggtttccccgtcggccctctctcggattcgttcttctatttcgtgtccgtggaggatctgggtcttaccggagaggagatgaagagactcatgctgaaaggcagtgtgatgatacgtgactgcgcttccttcggtgacaggttcagaggatacatcagatactgtgtgaaggacaggtccaggaatgcgaggttcatggcggccgcggaaagcgtcatggacgaactccagggaagatgagaccgtggagttgtggctggacgcggtcctgatagcgatattcgcattcctcatagaccgttatataggggacgttcccaacagataccaccccctcagatggatgggcaacctgttggattgcatagaccgccgcattatcgaccgcaggtcccggtggaacgttgtcatcggattcctctcctatgtcctggtccttttggttttcggaggggtggccctcaccataacgatggccttgcgctacggtctcgtcggtgtcggggagttcgatgtcctgggggtccactgtagtttcggggagatcgtgtggatcgtcgtatcggcactgttcgtgaaggtgaccttcgccctgttcgcattcaggaagttctgctcccctatagaggacgacctgaagaaaggtgacctggaggccgcagccgataagacccagatgatggtcaacaggaagatgaaagggatggacctcccccatataacgtcgtcctgctgcgagacggtgtcggagaatctcgtggacagtgtgatatcgccactgttctacttcggtctcttcggccttcctggtgcgatagcattcagatgctccaacctcatggatgcgatgtggggccacatcaatgaaaaatattatgtgctgggtcatttccctgcgagactggacgacgtactcggatacatcccctcgaggatatctcccctgttcgtcggcgttgcggccaagttgatgcgcatgcgcagtgggcgcagcgccgtgaaggcggccatggcggagcataggaagactcccagtccgaacagcggatggcctatgacggcggtggccgccgccatgggggtctccttcgagaaggagggggtgtacgtgatgggggagggacctcttccctccatagacgatatacgcagatgctatcatctggtggagttgacgtccctggtgttcctcctcatagtcacgatccctctgggtatgtttctggggatccatgtgcaggtgttcatagaggacttcatccatggtcttctgggggtgttccgaatatgagatatgtaagaagttccgagatccgggaagaaggtgaccacgaggccaccgccgtgatccgtttcaccgaaaagatggagatcctcagcagtgcccctctgaacggaggtcatgcactaacggatacggtgttcataatgcaggtcccgcatgattacgacggggactacatggcggatctccgttccaagcgggaccagtacgggcttccggaggactccgtaggcttcatgacctcggccgaggtgaggtatgtgttctccactgcggaggaggttttcgaaggaggggaggcgttcgtcgcggccaccgcaggtgtgaccaactgcgtcgaggccgggaataccctcgaccgttggggtgagaggaaggcccgttccgaaggcatatacaggaggcttatcgcaggtacgataaacatcgtggtcgtctcctccgttccgttggatgatgccgggaagataaatctcatgatcccattggtcgaggggaagacccttgccatgagggatctcgggtataccgagaccggtacgacctcggatgccatggccatagtgtcgccgcccgctgccgacaggtcccccttcgccggcacagggacatatctgggtatgtcttcggcgagatgtgtcagaaaggccgtggccgaatgcataaggaaaaggggggaatccccggagaccaaagactcccttacgatgttggccggtgcaggcatagggtccgatatgctgtggtcatgtgcttccgctctcggattggatgaatccgtgaggggcggtttcgaagaggtcctccgcaacatggcgggggatcccgacatatgcgccctcgtatacgggatactgtcctccggcgtgatggcggacaagggatgcataaacggtcaggtggagggggggatgccggagatccttaccgacgggaccttggccatattcctggccggaaagatatcggaggatcgcggaggggattccactgtggaccttctgaggatgaggcctctccgggaagaggatgtcagagaatatgcggagatcgctgcatacggtctggtggcaggtgtggtcggatatatgacggggttctcggatgactgaaaacagcgatgtgccagaaggtggcggtgagactccgaaggggggtttcgtctcggccataaagtgtatgatctcgttcttcacgataatacgtctggacgtcggtcagaaggaattcgatgccatggagaggaacttctgggccgcccccgtgatcggatttcttaacggactggtggcggccgtcgtatgccttcttctcgtcgaagtggatgcgagtcctttcctccaaggggtcgccgccctcgtgaccgtgttcgtgttctcaaagttcctgcatttcgacggtcttacggatttcggggacggtatgatcgtgtcttcggggagaagggaggaccatgtccgtgccctgaaggacagtctgatcggtgccggaggtttcggtgtggccctcaccgtcgtcctgatatcggtcgcatgttacaccgatatcgcaacatattggggaagcgtcatggcggcggtgttcgccgtcgaagtgttggcgaagaacgcccaggtggccgcagccgcattcggagaacccgggagcggtatggcctcgcgtcaggtgggtatgaccggtaagggctcgcttgcgaagtcttcggtcttatccgtcatccttctcgccgtcatctgcctcatacatcatgggatctgcggcctgatgggttatgccctgaaagacgatgtcatgattttatgcatggtgctgggtcttttgatgtcggtggccgtcggctggtatatggcccgtacagccaacagggtcttcgggttcgtcaacggcgacatcctgggggcagcgaacgagatatctagggcggtcatgctcatcatggccgtcatcgtgctgggattgtgcatctgatggaagctttgatcaatgccggtggaaaagggacgcgcatgggtccctgcggaatagagaagcctatgcaggtgataggcgggaaacatgtcgtccaaagggtcgtggaggccatgcgcggagccaaaggcatcgaccgtgtcctcgtatccgtgagtccgaacacacctaagacggaggcctatctgaaaagtatcggtgtcgagaccatcaggacgtccggtgaggatttcatgatggacctccatgagtcgttctcggtcatgagcggagattatgtcatgaccagtccgtccgacgtgcctctgatgacatcttccgttatagactgtacattggacagtttcaagcccgagatgcagtcgatgatcgtccttgtgaaggccggcatagtccgtcagatgggcatcgtcccttcgtatacgagggtcctcgacggggaggaatgggtcctttccggcctgtccgtcatggaccggaaggggacattggaagggaaatacctcaacgaatgctgtctgaagaccgattggaaggagttggccgtgaatgtgaacacgcaggccgaactcttccttgcgagaaagctcttctgatcactcgttgtcggcggtctccagagcaggtttctccgtcttcttggacctggtcttggaagcggacgtctttttagccgtcttcttggaagaccgtttgcggtcggagacgaccacggtgactacccttcctaccctgtcgtcggacgatgccgcggatggaacaatcccagtattctccgtctccgtctcggccgtctgtttcctcttcttgcggagagggcagtccatgtttatgcattcctttatggaaccgatctggacgacgggggcgccgcattcggtacagctctcgcctaccgggactatcgtccctctgggtctgagcggataggtctgagtgcatgcaggccattcggaacatcctgcgaaacgtcttcccgccttggagtacatgatgcggatggtacccttcttgcaggtggggcacggaccgaggtcgtttttgtccgtattgctcttgcacttcgggtcgatgcactgcagggacgggggcacacccttcctgatgacctttatctgtgccaacccgcacaccggacagacggagtcagtcatctggacaagggcacccttggggagcgggtatgcgcggttgcactcggggtatccgttgcagccgatgaagttcccgttcttcgacttcttgatggtcatactgtttccgcagctgggacacatgccgacgaactgctgtttcttcagcgcggcctttatctcgtcccctatggcaacgctttcggagtcgatcttgacggcgacgtcgcggagcatgtcctgcgattccttgaccacggattcgaggcttctctccccatccgttatgctgagcatatccctttccagtttcgcagtcatctcgggttcggttatacctccgccgtgatgctcgagggccttggtcagggctatcccgctggccgtagggatgagatagttaccttggacgtagtttctggagaacagtttcccgatgatgtcgtgcctggtggatttggtaccgagctggagtctgtccatctcttggatgagggaaccctgattgtatctgtacgggggtttggtctgggactcgtcgttggttatgcctctgacgtcgaccttgtccccgaccttcatgtcggggatgcggctctcggcggccctgaggtacttcccgtagtatttcttccaacccttctccttctgtacatacccgtcggccttgaacgtctcccctgcgacgtcaagtttgacctcggagacctccgccactgcgttcggtgccacggtggcgaggaaccttctgacgatgagttcgtagagcttccatttgtcccctttgatcttggccgaggtggctcccgcggtcgggtagataggcggatggtccgtcgtcctcctttttcctctggagggggagatcttctcctgcttcaggagttcggaggcctcctcggagaagtcggagtccttgagtctctcgaggacgcccctcagagagaggctacggggatactcggtgttctccgtacgggggtaggagatgtatcctccggtgtagaggtcctctgccagtttcatggcggcggaaggggggataccgatcttgttggcctcgacctgcatcatggtcgtatcgaacggcggcggcctgtactcctccttgatacccttctcgtagctcgagacggtcgcctccttgacgtccttggtcttgccgaagatctcgtcggccacatccttgtcgaatatctggcccttctcatgctgtcctttgaaggccagcatgccgaatctcccgtttatctcccagtaggattgcggcacgaagttctcgatctcctcgttcttgtccaccagaagcttgagggtggggctttggacgcgtccgaccgacatgaagttctttccgacctgtcctgcggacagggatatgagtcttgtaaggaccgctccccaggagaggtcgacgacttgtctggcctcggcggcgttggcgagcctctcgtcgggttcgacgaggttcccgaaggcgttctcgatctcccctttggttaatgcgctgaatttggccctcttgaccttggtcatgtccactccggccgctttgacggtctccatgccgatgagttctccctcgcggtcgtagtcggtcgcgatgatgatctcatccgcatccctggacagttcgatgatcttcgagaggatggatttgacacggacggtcttgatctgcggggcgttcacgaggtccacgggggaggtagccctccaatccccgtactcctcggggtagtcgagctccatgatgtgtccgcgaaggctgacgacgttgtaatcgtcggtacctgtgctgaatgtgagggaggtcacgcctccagcggatgccgagtgcgattttccgtccgaaaggatggtggcgatccttctggcggcgttcgccttctcggttatgataagcttcttcatcatcccccgtcagtctgtactttttatttattggttggtgtggatatgtgccttctccttatttttaaaattataaatataagcccaacccggaacggccccgtgacatccaacgcatagtttccgaatccagcggacgtcgagtttatatctatggatggatgtataatccatagatgggaaccgaagaagtcctgaggaagataagatctcgcgacggcgttttggacgctttcgtcatcgacgaggacgtcctctcgatgatcgaaggagaggaatctaacatcaggacatccgggggtctcgtctacgagaatctcgggatagacaggagcaaggagatggatacgcatgtgtgtgtcttctccaaaggcttcattacggatccgaaaggccccatggtcgtcatgacggacgatactggggcgatatacggtcacgacgttccaagaaaatgcaaactctcttcctcagcagtaaggaacggtgccgtatggatctcggacgatttcgtggtctatcccgacataatccccaaatcggagccgaagttcgtggtgctgccccgcagcgtcgacttcctggagacggagacgacctcgtacaatccggccctttccaccgacggtcttctcaaggagaggttcgggtttgggggccgcggggatttgaccacgaccatcgtcgcattcaattccggggcccagacattttaatggccggaatcctttgcaggtcgtatgttctccatttctgaagtggtcggaaaactcgggtcgatgcctcagatagtctcggtgtacatccccgatgaatcggatatcaggacattctatgaggaggagtcgagggtctccaccatatccgacatgcccatggagaacgaggccatggccgtttccaaatccaggaagcaccacctcatagtcgttttcaccgagggtctggagaattccccgcaccacgaggtcgtcatgaaggacggagacgggaatctggtggggtgggacgtccctccgggtctcgagtacgaggtggaagggagggacgacctcgtctggatgagcgaggatttcgtcatggacccctcggccatggaaggggagataagggtggttctggtggcgcagagactcacggtcatcggggaggacgacggggtcagggaccctgtggcgatgttcccctccccctccaccgacatgatgataagggagaggtacgggatcaccttggattccagatgcgccaccgccatagtggggttcgacgaggtctgatcccatcatatggggttcttttccgggtcgtaacggccgtcgtcgatgcgtgcctgcactatagcagggacctcctcgagatattccgtcgggaagtatcctgattttatgctcttgcttccggtggtggacagcaggcacacggtacagtgcgatactccgaaatgcctcgatatgaggtctcccgatatcttggatatctggatcctgtcgtactggatcatcacccattcgcggtccaaaaggccgttgcgcatgaccatcttgtcctctcccaggcctatgcggcggagaaggtaggaacgccatccgcgccagaacgcgtatgccgccgtgagtatggtcagcaccacgggggctgcacggatcatcgccatcaggacgtcgcccaccccctccatcatatccatgtgccagatcgtccagcacggccaggctgcgaccgtcaccagtatcgcatcgaagacgaccgcctggcacagcatcgtcttccatgcggccttcggaggggaaacctccggtatcttgcagtcgaattccgggaggaccttcttgatgagggcctcggcctccgcatccggcatcaggaggcagagcatcggcgtcgcagtgctggtcgcatcgatcccgaccacttcggcctccaggcacgatctgtgcatcatcctggcgagaagcgggcgtctaagccttatggcgttgatcttggccacgtcgaattcggtacggtagttgtgtagggctccgtactggagacatatcgtatcctcgtcgcggtacatcctgaatccgaagtaccttagcaggaccgagaccacggggatgacctcctggaccgcgaacatgaggatacctaccatcaatccgccggaactgttcatgaatatcgatacgaccgctatcgccaggaatatcccggcccatactatctgccacgtaggctgcgatattatgctgtggaccaccacctgtgcaggggtgaatgatacgacggattcgtgttcctcgtcgcggtccacctccgatcccgtatggaatgtgcgggagtagacgtagtcacgtatctcgtcggcgagttctttcttgaaggagaagcaggcctcgggagtggccgcattgacggaagagttgacgttgaagctcagagtttccgtcccggcgatcctgtcgaagatgttgcgggttatgttgacggatgccactctgtaatagggtacgaccttcgtcttccgcgatatgaagttgcggcgtaccgtgaaatcctggcccccgaactctatggatgtcgtcttccagaacatcacgatgaagaatgccagcaacgcgatgagggcgaccattccgacggcgatcatgtacgatcctccgtcgctgaccatcccgaatgcgattatggccaataccaagacggttatggtcaggttcttcacgataactatcgggtggttgatgtacggccccttcacagcatcgctcatgcacgtccccttgccctcagtaccttgttcacgatctgtcccagatcgttcgccacacgctccgcctcatcgggttccagatattggatctgcgccacccctccggcggtggtgacgaccacgtccgccaggccccacatgcggtttatgggtccgtgtgtgacctccacttgcatcacgcgttcgatggggacgaacgtgtggcggatgaatatgacgccgcacacgacatcgatcttctccccgtccaggagatagcggtaatggcggtagaatacagggggtgccaccagacagtatatcaggaggattgcgaaaagggcgatcagcgtgatacgtacctcgcgggagaagtccgtttccccgacggagacgtatatcgcagccacgaagatgccgaccaaggccaacaatacggcatagccggtatacatcgaggccatgcatctgcggttaagcctatggtagttttcggtgctttccattttatcagaggtccacacggggatatcctatatataatagtgtatgaaaatgttcatttaagtagtttgaaaaggcgtttccgtgataatgtgccagatcagtcgtttctgacgcctatgtaatgcaggtgggcagtggccttcgatgccatggtcagcttacatctgaggactcctttgagcgatccgaggtcgttggttatctgcttaagtttaccgagctcgccctccagtgctatgacctccatgcatctgtcatggtcgagatgcatgtggatggtggtcctgatgtcctcgatggaattatgctggatctctgtgatcttctcgctgagtccggtggtgtcatggtcgtagatcatggtgatgactccgcacatgtactccttgtcgttcttccactcgttctcggcgagggagtcgcggacgaggtcgcggatcgcttcggatctgctgacatatcctttcttagcgattatcttgtcgaactcggtcaggagatcgggttccagtgaaacaccgatgcgcgttacgccttccatgtgtctaatatgtatatcttgatagttaaatctgttgagatgacatacgatatggatacgaatttgttaatcaggggatactccaatccagtcagatttaaacggggcatggatatctgccacatatgaccgaactgtccgaaagcgtggcctgcgcattggactctgcagcacagaggctcctcggagggaaagacgtggccgtcgcattttccggaggcatagactccgggatagtcgccgcccttgccgtcaagtatgcgaagaatgtaagactttacaccgctggcacatcgggttcccacgacatcgaggccgccttggcgacggcacctctcatcggtgcggacatagagaccatcgagatacacgattccgacataacggactatctgagggaggcgatggcgatcaccgggacggacagcccgctcaccctcgccttcgagatgcccctgttctgtgtgatgaagacctgcaaagaggattcggtcaccggaggacagggttcggacgagcagttcgcaggatattcgaagtatgtcggcaagcaggacatacagctcagggaagagatggtcaaagacatggccaaactctacaaagagaccctcccccatgagaagaaggtggcggaacacttcgggaaggagatcgcatatccttatctggacaaggatctggtcgctatccttagaagtgcacctacggaggcgatacgtcccgtggaccaggacgtccggaagaaactcctgtccgatgccgccagggacttgggcctcgggtatttggccgaccgtcccaagaaggcggcgcaatacggttccggaatgatggatgcggtaaaacgcatctgcaggaagaggggcatcacatacaacaagttggtggcggacctcaggaaggagatggacggatattcgaggatgtgagtggatatgtccggcaaaagcggaggtaacgatgtagaacgtcatctgagatggctgtacggcctccagatgaacgggataaagctgggtcttacgaatataaaggaacttctccgcaggatgggcaatccccaaggttcctacaggtgtatacatgtggcggggagcgatggaaagggttctacgagtgccatgatcgcatccatcctcaggaaggcgggttattcggtcggattgtacacctccccccacatattgaggttcaacgagcgcataaacgtcgacggtcgggacatatccgatgaggaggtgtcggagctcacaggatatctgagacacttctccgatgacatgtgcgagagtgagatgttctgcacattcttcgagataacgactgcgatggcgatgcagtacttcaaggacaggaaggtggacttcgcagttttcgaagtcggcatgggtggccgtttcgatgctaccaatgtgatcgtgccagaggtgtctgtgatcaacaacatcagcatggagcacaccgaatatctgggggatacgatagagaagatcgcactcgaaaaggccgggataataaaagaaggcgtcccgagtgtgacgatcaatccggagccggcgttcggtgtcatagcatccgtcgcggcagagaagggttcggggctgaaacgtgtggatcccgaagacatcgagatcgtatccaatatcggaaaaggtccggaattcagatatctgggtcataattatttcgtctcgatacccggaaggaacgaggccaagaacgccgctgtcgccatagaggccctgagggtgcttccggaattcacggacaggatagaaccgtatgtcgccgacggtctcgcatcggtgagatggccgtgcagactggagaacatcggtaacggattcatagtggatgtcacacacaccagggcggggtcggagggactcgcatcggatgtgggagagatctatgggaaggttgtgctggtgttcggcatactctccgacaaggatgccgacgacatctgtcgcaacctctccaaggtggcatccaaggtcgtggtgacgcagccccaatgtctccgtgcgaaggccgcagaagaggtgctttcgataatgaagagatatgtaccggatgccgagatcaaacctaccgtcggggaggccatcgagagggctgtggaactaagggacgacggggaggaggtccttataacaggatctttctatatggcagaggaggccttgagatggatgggcaggacatcacagtgatattggacaggatgtcggaggtgtacaaccagggggcgtatccgggcaggaactccgaaggccttaatccggagtggccggccgatccgttccatgtattgatcgccaccatattgtcccagaggaccaaggatgacaacacccgcaaggcgtccgacaatcttttccacaagtatccttcgatcggtgacatcgcagatgccgatcctgaggatgtcgcatccctgatccgtccggccgggttcccgtctcagaaatccaaggccatagtggaatgctgcaagatactccgcgatgtctacggaggggtagtcccggaatccacggaggagctatgctcccttcccatggtgggcaggaagaccgcggcctgtgtacagacttatgccatgggcatacccgcggtctgtgtggatacacatgtccacaggatatccaatctgatgggtcttgtgaagacgaagaatccggaggagacggagttcgcattgatggagatcaccccccgcgagcgctgggccgacataaacagatatctggtccgccacgggcaggtctgctgtcttccccgtcatccccactgcgagagatgcatggtccgcgaccagtgcgaatacggtatacagcacagtgattgagacattcgggcgtgggacagtttttaatccaccctgccataccgttgtgcgatgcatgaggcctcggtggtcgcgaatatcgtggacgccgttctggaagaacttaagaaatacgacgtcacgaaggtgaacgccgtcaccatcgtcgtaggggacctcacccagctgggtatcgagcagatggagttcgcttacgaggtattgtcccaggggacggtcctcgagggttccaaactactggtggagccggaacacatagttctgggatgcgacaagtgcggatacgaaggtccggccaagatgatcgatttcggggaggatggttacggacatgatatcccggtcctcagctgccccaagtgcggaggccccgtgaaggtgttagaaggcgaggcctgccgcgtgaagaacatggatatcgaaacgagggatgactgatgttcaaatacagagacgagcagaccgccaagaagatcctggcggccatcaaggacatgggagtgaaaggcaggttcatgcacatctgcgggacccatcaggacaccatcgtgcgtttcggtctcaaaccgttgatggacgatgtcgggatagaggtccatcagggtcccggatgtcccgtatgcgtcacgaccagcaaggagatcgcggatgcgatcaccctcgccaggaacggtgtgaccatagccgccttcggcgacatgatgagggtaccgacgaccataggctccctcttcgatgcgaagaccgacggtgcggacgtgaggatagtctactccgtggaggatgccgtgaagatggcgcacgagcagtcgggtcccttggtattcgtcggggtgggattcgagaccaccgcaccttccacgggcgtccccctccagaagggtcacctccccgagaatttcagcatatacagctgtcacaggtataccgctccctgtgtggaggctcttctgaacatgggcgagagcaagatagacggattcataatgcccggacatgtggccgtggtcaccggtacggagccgttcaactacttctccgagaagtataatcttccccaggtggtctgcggtttcgagcctctcgacatgctgatgtcatgctacatgctctgcaagcagatacacgaaggccgtgccgaggtggagaacgagtattccagggtcgtacgcccccagggcaacgataaggcccggaagataatggatgacaccttctatgcggtggatactaagtggaggggattcccggtcatcaagaagtcggggatggctctgcgcccggagttcgagcagtacgatgcgaccaaggtccacgaggatattctcaggaagacccccgatgtggaggaggaggccagcggatgcaactgcggttccgtcctcaggggactcatcgattcggaacagtgccccatgttcgggaaaggttgtaaaccgacctccccaatgggaccgtgcatggtctcagccgagggtaactgcaacatcgcctacaggttcagggggaagctctgaatgatggagaaggcttatcccaaggcccccaccctggtcctggtcataaccaacgactccaccgtcatgctcaaggacggcatatgcagtgcgttcgaactgttcggcggccgtgcccaggaggtcaagaatctcgtggcgagattggatctggccaagaagaaggatgggtccaagctctgcgaggtctcattcgggatgataacaagccatttcggttatgtgccggccgattatacggtcatgaagtatcctgccgaagaggtgatgtccaaaccggaggactatgagcgtgtccagggtcagaaggattacctggggaagatcgagtacacctccaagcttttcgacaggatcgtggtctgcgtccccaagcacatgatggagatgatgatggagaaggacgtccttccgaaagggagggttatcgctgtcaccagtcccgatctgaaggaggagtgcgaggccagggactggatgtatctggagaggcgcggaccccgtgtaggttccgagaacgcggacctcataatgaacgagatcgtcaggatctcgccttgaatcccttaaacctttctttcaatctttccttatccgcggccgagaccctgaacgagtcgcggatctttcttacagtcatcctcaatatctcgttgctggcacatatggagaacatagcatcttcggtcttttccgggtatgatatgtagcagcatgagagtgtccatgcggcacccatgtcgtagtagtatccgggactccgtaccgtgcacatgagccttatgacctcgtctatgtgacggtcgtccaagaaatggtccagcatcatcacggctccggccctcatgggaaactcctctccggtgtccaacagttccacacacatgtgccagagtttttctgaagcgttcccgggccctgttctgaacgctccgcagaacgtgtcgcacaccgcccaattatctatttcggggacgaatccggccattctttccagcctctcgtccgcatccatctccgccgttgcgatgacgagggcccttatcatggattgttcgaagcttcccgtatcctcttccaggaaaaggcgccaatcgccttttatgacgtctttcgctatggatctgagggcgggcatccttacgccgtacatcttcccttcgtacgggactatccgggagttgaactccttatactccgggtccgatctctcttcgaggatcctgtcgatttctccgaccctcatctgtattccttttctatggtgaggagtctgatcttgagcgcccttccgccggcatagttcccggtaccgtctttggggactacgcggtgacacggtatgatgagcggtatcctgttcagtccgcaggcggtacccaccgcacgcgatgcgccgggacggccgatcgtttcggcgatctccccgtaagtcgcggtcttcccataaggtatggcgcatacggcatcccacacatccatctggaattccgtgccgtcctgatatactggcacatcgaacttcttccttcttccggaaaggtattcgtcgatctcttcggaggcttgggaggttatgtcgtcctctctgtcctccatcgccgggagattctcgcacgggaggtagacggcggtcacgctatggccgtcgctgcatatgctgaccatgcctatggccgtcatgtacgtgtggatgtgctctccctgcataacggcccagtattgtcctgaaaactacttatgtgattccactgttggaacatacatgataatatgcgccagcagacgtaccgacatccctgctttccatgccgagtggatggtcaaccgtctccgggcgggctactgtctggtgcgcaatccggtctacaggcaattggtctaccgggtggacctgacccgtcgcaacgtggatgcgatcgtattcatctctaaggacccgcggccgatggtcccttatctcaaggagatcgggtccatgggtcacatgtacatgttccagatcaccatcaacccctacggaagggatctggagccaggggtcccgttcaaggcggatgtggccgattcgttcaaggagatatctgacaggatcgggaaggacagggtcgtatggcgttacgaccccatagtgataaacgacaggtattccatagactggcacaggcgtaagttcgagcttctctgcagggagctggagggttatacggaccgctgtacattcagtttcatagacatgtacggcaagctggggaagttcggcgaccgtctgcgttcggtctcgttctcggagatggaccgtatggcggagatgatggtaccgatagccgagagatacgggatgagattgggatactgctgtgcccaccgcgacctgtctcagtacggtatcgaaccccgcggatgtatcgacaggcagacgatgcgctctctggacatcccgttcgaggagatggatacccctctccgggaagggtgcaggtgcgtaaggaatatcgatatcggggagtacaacacctgcagccatgattgcctgtactgttatgccaatacgaacgacccctcatccaggacggaaaaggtatacgacccggagggggaactcctcttcgggacgttgggtcccgaggacgaggtcgtacccctcaaggggagagagacaccccgtctctcggattatttcgactacaggcagtattgattcattcccaggtctgatgcaggccggcctccctgtccgcttccagttccctgttcatgcgtttcttggagaacaggacggagtccatgaacgccacccagatgatctcgatcacgatggatgccgctatgggcaccattgcgctgccgatggccggaccagtcatcacggatacgcagagggctatggctatgcctttgttcttgtaggatatcatcaggatgtcggtgaccctctgggaccatggtatcccggacttcttctccatgacctccgtggcggatccgagaccgaagtccctgaggaaagcgacgaacatgaacacgaccaggatcaccatgtccttggggaagttggtggagctgaccgacagccagacgaggaatgcgatgacacagttcaggacgaccgacatgaccgtcttgtcgatcttgaccttggttatgagtctggagaccaccagaggcactccgatgagctctatgacggttatgacgaccttggtcatatccacgatctccccgagggtgagccatatgatgaacgggatccataccagggagatcacgtagacgatgatggtggatctgagggcatgttccagatcccccctgaggatgagggaaagcggtcctacggatgcggcgaacggagtggccgccaggaatacgagccccttcgcatacgcctcgtatccgtccatgctgttgaggatgtagtatgctgccagggggatgacggatgcgaacacaagacccaggagcacggcccttatgacggacctgtagttctttacagggtccaggttcctgaacgggatcctggatagggtgatggtcagcatcactgcgagaaggaatatggtaaggttgctgcggatgtccgacgtcaggacatcgtcggggaatatgcccgatacgttcgtaagcaacgatatcacaagtgcggcgcccatcatgaacgcggtgctgcatacaaggtttatcgctttcatcgggcaagtaaagtgacatccgtatatacggaattcgttgatattatgcgatggacgtcgttattctggacaatgggggttaatgtattgtccgtgacctttggtcttatccccgtattgtatggcgaaactggggcacctgtgcaggcatccgagacacatgacgcaactgtccatggtccattccggtcttccgtcacacatttttatcgcatgcaccgggcagaactccgcacatctcccgcaccctgtgcaatgttcctccactgtgaggttctcggtcctgcgggccttttcgtagaggctgtagaacatcttcgatatgaactccgggatgcggtccttcatgaagacccctttggatctggatgctatctggcacatcacctcctccaatttctcgtccgccgtcttcactctcttggagatgttttcctcattcgtcaggtcgaacacgggggtccatgtgtcgggcatcctcacctcgtatgacgcatccatgtccacccccttgtccttgagtatcctctccgccacctgggtgatggcaccgttcttggtgccgtaggtggcgacgaagaatgtgtacggtctctcttcgaacgacagctccactcttctcaggaaatcctcgacgatcgtcgggagaccccaataatatgtgggactcacgaaccctatcatcttctccccggatacgtcgaaggaaagctctccggacgtcagaaggtctgggatatatgccagtctatcgtcgttggcctctgcgatcgacctcgctacgtgctcgctgttccccgtggcagagaaatagaatatcattcgaccatcccccagatatgtcaggacgattacttcaactgaatatatcctctttacgtcattatttaacacatattgggttatgataatggtgcgggtccaaggtttatctatccttttcattatcctcccggcatggcggacgtgaagccggtgaaagccggatggttcaacgttttcagaccgtggacgctccacggggcggttgtcccggtcctcatcggaggggcggtggcatatcatgacggggagttctgctggtggatcttcctgatggtcctggtgtgcggatgccttctgcagtccgcggcgaacatcctgaacacctacggtgatttcgtaaaaggcacggataccgtggagaacgagacccgctcgcccgaactggtcaccgggaccctgtccccggagaaggtcctctgggcaggattggcgtgtctgggtatcgtcgcgttatgcgggcttgtcttcatctggtatatagggtggggcatactggcgttcggcatcgtagggctggccggggcaggcctctatacggtgggagcatcctacaagtatcacggtctgggacagataggggtgttcgtcctgatgggcatcctcatgcctctcggcacgtactacgtgatgtccggagatctctcctgggaggtcttgttgatgtccctgcccaatgcgttcacgatcacggccgttctgagcggcaacgagacgagggactaccacgaggacaagaaggcccacgtagggactctgtccagtcatatgtcctacgagaacagcatgcgcctgtatctgttcgagaacacggtgggattcgtcatactggcactgttgatcgtcacagaggtccttccctggatgtgcgccttggccttcatcaccttgtatgacttgtacatactttacgcgaacagcaggctggcaccttccgatcccgggaacagcaggctcctggtgcctatggcgttcaggctcaactggcatttcggagtgcttctcgtgataggataccttatagcgtattacatattctgagggctcataatgactgacgaagaggtaaagatgaacggtacccagttcgaaggtaaagaggtctatgtaaaggacgtcttcaccgagatcgcgggatactacgatgagatgaacgagataatgtccctccggatgatccagggctggcacagatacatgatgaagctggccggcgacatcagggggaagaagtgcatcgatatcggcacaggtaccggggagatcgccttcctcgtcaaggagaacgccggcccggaagggaaggtcataggtctcgacatcacccccgagatgctcaagtacgccgacatgaagatgagggagaacggacgccccgaggtggagttcgtggaaggggatgcactggatcttcagttcccggagggatcgttccacctggtcacctccggatacatgctgaggaacgtcaacgatgtccagaaggccatagacgagatgtatcgtgtcctggaccacgggggaaaggtcgtagtcgcggagatggcgacccccgacaaccgtttcatccgctatttctacaacctctatatgaagaaccgtgtacagaagatcggtcgcaagtacgataagggcgagaagatcgacggcaagatgcccgcgtacgactggttggtcaactccatcaagggattcccacatggagaggtcatggcggagaagttcaggaaggccggtttcaaggatgtgaaggcccattccaagaacttcggtgccgtgaacatatacgagggcaccaaggagtgaccttcggtctcttttaatatatatataataaaaatatgaagaaggggaggggggacatcccctccccggttttctttctcagatggtcttgggcttcttgtagttgaagtatgccaggacggctttgtacagcatgtagtcgtcggccttcgaggtgacctcgaggggcgcatgcatggacagtacgggtacacccatgtcgacggtgtccaggttgtgtacggagatgtccacggcgatggtccctccgcctcccacatccgtcttcccgagttctccgacctgccactggaccttggcctcgtcgagtatgcctctgagatatcccattacctcggcggaagcgtcgttggtggagtacttaccgccgctgccggtgtacttggatacgacgggtccccttccgaggaaggagcagttgttcatctcgaacgcctcggaccatgccgggtcgacggccgcgttgacgtcgcaggacagacacatggagctcctgagtacgtggcggatcgggtagttccaggcggatgcgacgtcctccaggaagtccttccagaatacggacctcatgccggtgggtccgtcggatccggtctcctccttgtcggcgaagaccatcatggtggtgaattccggctccttggtgtccagttcggctttgaactgggcgaaggcgcagaccttgtcgtcctgaccgtaggcggcgaccatggatctgtcgaatcccaggtccctgggctggaatgcggggcatgcgcacagttctgcggaaaggaagtccgtctcggtgatgccgtatttctcgaacaggatgttcatgatgttcagtttgaccttctgggacaccttgtcgtccttgaagggccaggagccgatcaggatgttcatctgttcggcgtctatcatcttgttcccgggcttggagacctggtcgcgtgccaggtgggggagcaggtcggtgatgcagaactgcgggtcttccggatcctctccgacccttactttgacggtcttgccgtccgcaagggtgaccactccgtgaagcgagagggggatggcggtccactggtacttcttgatcccgccgtagtagtgggtcttgaaataggccatgtccgtagattcgaacagggggttgggcttgaagtcgagcctggggctgtccacgtgggcgacgctgatcctgacaccctcgatgacgggcctctttccgaacgtcatcagaatgaggttcttgtcgcggttgttgaagaagaccttgtccccggccttgtatttcgtaccgagtacgaactcggtgtagccgttctctttcgctatagggagcgaataatccaggatctcgcgctctgtcttatgtttgaggaactccttgtattcctctccatattccatagcctctccgaggagaccgttgtcggtctctccgaggaccttgggcttcatcagaagcttttcctcgagttcctggccagcgctcttgtcctcttttttgctaaccatgcttttctgcatgtttaggcggatatttgacacattcgcaggaacggcttttggatgaagtcgataatgggttgatgtttcccaatgaattggtatataaatctatttacgaatgatgtttattttgtaattgttatatttaatattaactttttggaatccgtccaaaatttataatatttaaatatttttacttacaatcgaaaatccttatatattgagcattcaaattttacatccaacagcgaaactggggttacagctcttccgaaatgttactcaactcctcgctgccgccggtctggcgaccggttgtgtccgccctcttactctctggcggacacagaatctcgtcagggatgcaaataaagtgatttactatgtctgaagaaacgggtgtagccgagggcggtctgaagcgctcggtaagctggaagcaggggatgttcatcgccctaggcgtgcctctgctgatccttccctcattatatgatgtaagtagcatcgtatgggggctttgtattgttgtgtggtgtctttccgtcattcagggattcctgcagaatctcgcatacggtgagatggtcaccgtattccctaatgccacaggtcttcccgggtgtgcgcaaacggttttccaacctaagaataagtccaatccccacgatctaaggaaattcgtcggggccttcagtgcctggtgctactggttcgcgtggtgcccggtggtcgccatcttcaccatgctcatcggtgactatcttatcaggatgttcgacctggagctggccggatgggcaaatctgggtctttatctcgccatcggtctttgtatcgtcattctcatgtacgtcctcggttcccgcggactcgagggaggtgccaagctcggtaccattcttgccataatatccatcgtcccgatcgtaataatcatcgcaggtgcgttcgtcaccgggatgttcgacctggatctcatcaccgaccgtatgaccgctcccggatggagttggggattcgaggacctcgtcctgctgttcggatgcttcggtctggcacaatggagtgcctgtgcctgggagacggccgccatctacgggcccgagtacaaggagcccggaaaggacgtccccaaggccctgttcagctgcggtctgatctgtctgttcatgtacttcttcgtatccgtcggtgtgtacgggtccgtcgacaatctcgacgcatacggaaacgccgccctcgtccccatcgccgagaaggtgttcggagacctcgggaagtacgtcgcactgttcctcctcatcgtcgctatgatcctcgtcatccagaccgggttcctcggttcctccaggaccctgttctccatggcacaggagaagaacctgcccagctggttcctcaaggtcaacaagttcggcatgcctaccaacgccatgctcttcgtcagcgtgttcaacatgctcctcgtgctcatcgtcggttacagcggatgtgtggccggatcgggagacacgaatatgacgatcctttcggcatccgccatgggatactgtatcgccaacggaatcgctcttgccgcgttcgtcaagaccaggagggatgcgaagttcaagggtctcgacaggccgttcaaggcacccagaggatgggagtatctgatcgccgtcatggtcgtgatacagttctgtgtatggcttccctgcctcatctactggagctacaatctgtccggaggactcatgcccgcgatcctcggtgccgtcatcctcctgctgttcatcccgctttggtggtatgtgcaggaccacaaggacgacgtgtccgaggacaagtgctccggaaaggagtgataaaccccaacaaaccccttaaaggggggcgcatagcccccaatatttataaagtaaactacacacatggattataattgatggatgattgttacatccaatcgggtgttttcgatgggatgttacttaacatgggtgatgtgccatcgtcatatccgacgccttcatccgtgagatccgctcttatttccgtttgttttatatattatattaagaagagatgtgaattgcatatcgatgatatcggtttttaacgaaatggggtattttgtcaatataaaatctggagcgatcgccttatgcgacgggagatttggccagatctgttctgttccaacctcttaaacacggtttgattctccggttttttacttgtatgtggaaacgtacaattactgggtggttaatggttccaaccatcagtatataaaggtatctcttaactatgattgagctcgcaggcatctaatatataaatgtttgtttacagtcccgattaaggttaaatacatccaacgtcttcctaaatccaacggttgcgtagcagccgattgtgaggagagagaaaatatggcaggatttgaaaacgagaaaaaggccctgcaggatgcaatggttgcatacaaagtacctggaattcttgacgcagtcgagaaagccagggcagccaagatgcctgcaaacgacatcatcaacgcaatgggagacggaatgaccgaggtcggagttctcttcgagaggggaaaactcttcctgccccacgttctgtccgcagcagctggaatgaccaaggccatggaagtcctcggcgaggaccttaaggcacagggcggcgcagaggccgcaaagaaggcatccgtcgtcatgggaaccgtcgagggagacgtccacgacatcggaaagtcgatctgctccaccatgcttcagtgcgctggattcgatgtccacgatctcggacgcgacgttcccaagcagaagttcatcgacgagtgcaacaacggctgcaccatgtgcggaatgtctgccctcatgaccaccaccatgactgtccagagggacgtcatcgagatgatgaaggaagcaggaatccgcgacaagatcgtcgttatggtcggcggagcacctgtcacccagtcctggtgtgacaagatcggtgcggatgtctacggagagtccgcttccgagaccgtctccaaagtaaaggacctttgaaaacgtaatttacaacctaaagaaggaaatccaatggcagcacaggaattctacacaaggatgggtgacggaaagagggtcaccatgaccaaagagcagatcatggcagacctccaggccggaaccgccgacgcggcagacatgggatccatccccgcactgaccgcagacgacctcgagaggctcgcagacatcatctgcgacaagaacaggatcgtagcagtcgagcccggaaacgaagtcgttctcacctacgacatcggacagctcgacttcaccggagacaacggaaactccggaaacggagtcgacatgggcaggctcgaggccgcccttatccacgagagggccctcggtgcagacaccttcgagctcgctcactccgactactccatcaaacccgtgaagcctgtcatcgcaatggagatgcagaccatggaggagatccagcaggagatcgtcgcaccttacttctacggtgcgatgcccaacatgggactttactacgcccctgacggaccctacggaaaccccgcagacctcatgagggagttcaagatcgacgagtccatgcagcagtccgagctcgcagcagagcacatggcaagggacatcgagtacgtcggaaacaagatcatctccgcaggagccgacggattcgacttcgacaccatggcatccgccggagacgccgacttcgtcggtggactgaagggagtagaggcactgaggaaggccaaccccctggcatacatcaacaccggaatggccggagagtccgtcatgggaatccacggcggaatcgagttccacggcaagaccgtcgcaggactcttcccccaccagcaggtcaagatgtgcgaggaggccggagccaacgtcttcggagccgtctgcaacaccaacaccagcaaatccctcgcctggaacatggcaagggcagtcaccttcgtcaaggagtgcgtaaagcaggcaagcatcccggtccactgcgacctgggaatgggagtaggtggaatccccatgttcgagaccccgccgatagatgcggtcaccagggccagcaaggcaatggtcgagatcgcaaagtgcgacggtgtatagatcggagtgggagaccctgtcggaatggacatggcccacatgcttgcatccggaatgggcggaatccgcactgccggagacctcgttgcccgcatggagtatgcgaagaacatgaaggtcgacaaggcaaaggagtacgtcgcaaagaaattaggcttgtcgacgctcgacatagcagatgagcacgtaatgagggacctcagagaagagctcaagatcggcgtcgttacaggacttcctggagcacccaggggaatcgcggcaaagatgaacatcgagaagctgcttgacatcaagatcaacagctgcgagaagttccgccagtccctgaagaactgaggagtaaaacacttacaaaataaaggaggaagagagtaatgggagtaactacacccgagtatcccgctcagaacattctgaacggaatcaaattcgaactgttcagcgacgatgagatccgcaggatcgacatggctaccagggatgtcctcgagacatacggtgtccaggtttcggacgttgagggaagggagatcttcaaggcagcgggatgccccgttgacgaggagacccagatggtcaagatccccggacacgtcctcgacagggcactttccaccgtcccgaagaaattctacctgtacggacgcgacgagagcaggaccttcacccaggagtggaaaggcaaggtgcactacacctgcttcggaaccggtatccaggtctgcgactacaagggccacggcaaatacgagaccagggactccaacgaggaggacctcgccaacatcgcaaggctctgcgactggtgcgacggactgtcctacttctccctgcctgtttccgcaaggaactgggctggaaagggagccgaggatgtccacgagtgcctgacgtccatgatgaacaccaccatgcacttccaccacatcgaccccgtcgctggaaacgtcgagtactaccgcgacatggtcctcgcatactaccacggcaacgaggccgaggcaaaagcgaagcccatcatgtccatgctggtctgccccacctcccctctcgagctgtcctacaacgcagctcagtgcatcatcaagggagcaaggtacggaatccccgtgaacgttctgtccatggccatggccggcggatcctcttccgtcttcctggcaggaaccctcgtcacccacaacgccgaggtcctttccggaatcgttctgtcccagctgacctgccccggcgcaaaggtatggtacggatcttccaccaccaccttcgacctgaagaggggaaccgcacctgtaggatcccccgagctcggactgatctccgcatccgtcgcaaagctcggacagtactacaagtgccccgtcttcaccgccggtatgtagaccgacgccaaggtgcccgatggacaggctggtcacgagaagaccatcacctccctcctcgcagcactcgctggcgtcaacatgatctacggatccggaatgctcgagctcggaatgaccttctccatggagcagatggttatcgacaacgatatcatcaggatggagaggaaggtcatggagggtgtccccgtaaccgacgagaccctcgccgtcgacgcaatcaaggagatcggagtcggaaacgacttcatcgcccacccctccaccatggagaacatcgaccttgcgtccgaccccctggtattcgacaggcttatgctcggagactggaggaacaacggctacaaggatgcagccgacgttgcccacgagatcgtcgtcgacgtcctgaagaaccacgctgtcaagcccattgacgccgacgttctgaaggagatgcaggccatcgcaaagaaggccgatgaggcgtacctcgcccgcgcaaaggctgaggagaacgagtaaacccagtaatcaaacgccttacctgccccggcagcgatgccggggcgaaaaatgaggagaagagtgaaatgacccaggaagagcttaacgagagagcaaagaaagcagttctgacctacaacatcaacgagtccaagaaagtagcgcaggatgcacttgaccagaatgcagacatcgtcgacctgatccagaacggattcaccgttggaatcaaccaggtcggagacctctacgagcagaagaaactgttcctgccccacatcatggcggcagccaacgcaatgaacgcaggagtcgacatcctgaccccccacctcggtgcacaggccaagaccgccgacaacctcggaaagttcgtcatctgcaccatcgagggagatatccactccattggaaaggatatcgcagccatcatgctgaaggtcgccggattcgatgtcatcaacctcggccgtgacattccgctcaaggacatcgccaaggcggtcgccgacaacaacgccatcgcagtcggaacctccgccctcatgacctccaccatggtcaaccagaaggccttcgaggagatcatgaagaagcagggactgaagggcaagtgcctcaccaacgtcggtggagcacccgtcacccagcagtgggccgatgagatcggagcagacgtctactccgagaacgctcaggactgcgcagccaagatggtcaaggctgtcaagggctgatttcgaacaacaggtcgcatccggtgggtgcgaccttaatttcccttacataacccgccgcacctatgtgtgacggaggtggtagtagtggatgcaacaaataacgcgtcggccggagtgccgatcagtatcgaagaattcaagaaagcggatcataagaagaagatccgcttcggactcatcatgggtatattctgtgctctctattggggagtatggtacgttcccggatatgctatctggggattcgacagtttcctgtaccctgacatgtctgcaaagggcataagttcagacttggagtcccttcttgactgtctgttcttgacatgtattaatgcgactgcctgtgcacttgtcctgttcatttggaacggtgctcttggaaagttacgcgaatggaagagaacccttatcgaagtgaaggctgcaagcaagtacttcatgctcgctggactttgcggagcatgtgccgtgtacggtacatacatcgcagctaccttcctcagccctggattcgctgccgtcgccggactgctgtatccgatcatcggaaccatcatgtccgtgctgtatctgaagcagaaggtttccaagagaggatacctgtccatcatcgtgctgctcgccggtggaatcactctgtatgctggatccatgatcaccggaggatccgtaggtagcaacgctacgctcggagccatcggaggaatcatggccgcagtcggatggggattcgaaggagtcgttgccggaaaggcgctggatgtctgcgaacccgatgtgggtctccacctcaggttctgcttcgaggccgtattctggtggatcgtcatgatcgtcctgatctgcctcggatacccgatgctcgataccatcggacagatcgccaacccgagcgtattcctcgcagtgctgctgatcggactgtctttcgcctggtgctatgtcacctggtacaagtcgttcccgttccttggagtcgcaagaggacaggctgtaggaagtctctatgctgcatgtgcagttatcttcctcatcatcttcttcgggcccgtggatgcactgggttacgatgacgattcgatgctgataatcgtaggatccactatcgccggtctgatcatctgtctgatcggaagtttcctcatcgcaacggaggatacggaaggaatggtcagcctgaaggatacgtccaagatactcggaggtgacaaggaatgataagagatgcacctgttaagttccgcataatggaggtcttcgaggaaggagggccccagtggaactatgaagtggtccctaagatcatggaagagtatggaatgcactctcaccacgagcagcagatggtcaactacgacatcatcgagatggtctctgccggtttcctggaggaaggagagtctgtgatcgatgaggaggggaagttcaacaaaggacacctcctcaccaagtacacgatcactcccttgggtatcgccaccgtggacgatctgaagaagaaggtgagacactatgaatgactggagcggatacgccgactacttcactaacggcattcccgccggggacataatcagctcggtgttcatcgtcggactgtgcgccctcggtgtgatcgtcgcaaggtggatgtacaaccagctctgaaagagaagtctgtatcttcctttccaataaacagaaggggcttttgccccttcatcaaatttccttatgtggacttccgtttgtaaaaatcatctaatcatccaatctgtttttcatatgtgccagatgtaggattttcgagtaatctcctatggcaattgatgacaattggtgtataatttcaacgaggtagccgcgttccggatcgatcgtgctacagtcttttgaatgatctttccagacatcctgttcattctttacaggttggccggatcgtgggtcttggggatctatagttcttattatatgtataatgaggagaggcgggaatttatcggacacgtatgccatagggcatcgtattgcgtatggcggaggtcattttccaaatcacctcgtcaatatgcatttccgagggtgtttcttcgatcctatttcctctaaaccccattggggattttcggtccgatcctgagaaaatgtgttggttttccaaccttctttggatgtaccgggccttgttttgattatatttataaacttttctactaacgacattgatgacttttagaagtgatatttaaatttaattaatctttatttttgttatttttaaaatttataatatagactcctatattttagactattaaacaattattaactgtttatttttcttataattagacatatgtctattgacatgaaaaaacattagaaaaatcatataaacagtaaaatataaataatagatttaacaaagtaacattgtttgtaaaaagtattaaatactaaaaatcaacatcaagttatcagacaagaaagagccgcaaccatgacagtaaggttgtggcgggatcctgtcgtctggagtggtataaaatggcaaacgacgcaattattgctgatctgaaaaagtccatcgagacctggaacgtagctctctgcaaggaggctactcagaaggccatcgatgcaaagatgtccgtttccgagatcatggacaagggtctcggagagggaatggcagtcatcggacagaagttcaacgacgctgagatcttccttcctcaggtcgtcgcagcttccaagaccatggaagtcgccctcaagatgctcgagcccctgatgtccggtggatcctccgccaacaagggaaccgtcgtcatgggaaccgtcgagggagacatccacgagatcggaaagaacgtctgctgcgcaatgctgcgcggagccggatacaacgtcatcgatgttggaccggacgcagactctcagaccttcctggacgcagccgaggagaacgacgcaaaggttctcggaggatccgcactcatgaccaccaccctcgaggcacagagggagctcgtcatcgccaacaacgaggacggcaagaagtacaagtgcatcttcggaggagcaccctgctccaaggagtggtgcgacgagatcggcgcagatggatactctgcaaccggatccgagatcatcgagctcgtgaagtccctgatgtgatcggagaacgatcgaatatcaatctaccaaggtgataaaaaatggcagcaacaagagcacttaccgtctgcgacacctacgacaggttcgtaaagggaaagaaagtcgacgaggccgagtgggactacaccatcatccctaagaacgcgaccgagctgaagaacaagtacaagctcgacttcgggaagaccttcatacccgaggacaacaagaccaagaacgacctgttccaggccggacttgagatgctggtcaacaccggtttctacaacatggatctcaagaaggtcatgcatgtgaccgaggaagaggtatgggagggaatcaagaagacccccacgaaactgatcctcggtgagggaagggacatcgctcgcttctaccccaggcacggaaacagccctgtcaagcccatcatccagggaggacctaccggatcccccatctccgaggacgtcttcgtccaggtcatgcagtcctacgcccaggagggtgtcgtcgacgacctcgtggacggagttatgaccaccatcgagggacaccccgcaaaggccggaaccccctacgagatccgcgccaccatggcggagctccgtgcaaccaaggaagcgcgtgagagggcaggacgccccggactcggcgtatagggacctgagacccctctgaccgaggcagcaaggcttgccgcggacatggtccacgcaggacacagggtcaccgacgcacacgagtgctcccagctgaacgagctcaagatggacatgaccggactgaacatgctggccggctggaccgtcaacggcgacaccatcatgatcgagcagatgcccatcttcggtggatactgcggcggactcgaggagaccgctatctgcgacgttgcgaccaccctcgcatccttcgctctgttcaacggaaacttccacctcgacggacctatccacatcaggtggggaactaccaccaacagggagtccctgcagatcgcagcccacgccgcggcagcagtcgacgccaacaccgacctgctcctggccaaccagtactacccgatggctggaccctgcaccgagatgtgcctcatcgagaccgcatgccaggccatcaacgacaccggttccggaagggagcttctctccggatccgcagccgcaaagggagtcgtccaggacaagaccaccggaatggaggcccgcgccatgggagaggcagccctcaccgcagctggaatgaaggtctccgacctcaacgagatcatcgagaagctcgtctccggatacgagcagcactacaacgatgctcccgccggactgaggttccaggagtgctacgacgtcaagaccgtcaagcccactgccgagtacctccaggtctacgacaacgccatgcagcagctccgcgacgccggactgcccatcaagcactgatcgcagatcggatctctctaaactctcaaacaagggggcgaaagccccccgcacttaccccccgggtcaccaacgcggaaacggtggcccggaacacatcaatatcgttgatgcggaatagtggatgctaaacgacttaagcaaacattttatagcaaactgggaatggattacgtatgactgcctcgaggcctgtggatatcttcgaagcgtattcacgtttcaacacgggcaaaagggtccgtgaggatcagtgggactacatcaccgtgcctacgaacgccctcgcgatgaaggagaagtatcagatcagtttcggcgatacgataatccccgaggacgaggacctgtcggaccgtcttttccatgccggtctcgacatgctgatcaccaccggtttctataacacaaatctcggcagggtcatgtatctcacagaggacgagatactcgaagggataaggaaggcgccccgcaagataaccatcggttccgggaaggacaaggtcaaatgcaaatcccgtcacgggaacagcaacagggcgccgataatcgaggcgggaccgacaggggcccccgtatccgaggagatattcccggcgatgatccagtcttacgtgcaggagcctgtcgtggacacgttggtcagcggagttctgaacactgtctgcggggagtccgccaccacgaacaccccttgggagatccgtgccacattggcggagataaggtatgtgagggaggcctgctccatgtgcggaaggccgggtatgggcatatagggtccggagacccctctgtccgcggcaggacgtctctcatccgatcttaccgattacggtctgaggaagcacgacctccatgaatgctcgcaactgaacgagatgaaggtggacatgtccctcatgaacatgatcgccggatggaagaccgctggcgacctcatcatggtggagcagatgcccatgttcggaggttattgcggaggtatagaggagacggccatctgtgatgtggccgccacattggcctcttacgccctcatggattgcgacatccatctcgacggacccatccacatcagatggggtacgaccaccaccagggagacgctgcagatcgcggcgcattcggccgccgccatcgatctcaacacggacctcctcctgggtaaccagtactacactctggccgggccctgtacggagatgtgtctgttggagactgcggcacaggctataacggacaccgcttccggaagggagttgatctccggtgccgcatcatccaagggtgtcgtgaaggacaggaccaccgggatggaagcccgtatgatgggtgaggctgccatatccgcggcaggaatggacatccaggaggccaacgccgtattggataacctggtctccctgtacgagaggaatttctcccgtccgccggtaggtaagaggttccaggattgttatgacctcacctcggtgactccgagcaaagagtatctcaaggtctacgaaaaagcgatatccactttgaacaaatgcggtctcgatatctgagtctggcacatgtgccagagtgtgtcccaccaaggaaagatatttagatattgggacagattacccaccaatgggggacggtccggcgaccagcgggtctctaaaacctagccagcggggttcgacgccccggtctctcgccattcttacatttcaagtgatagtatgacggtaaagtatacggatgcacagatacagcgcctcagggaatacggcaacgggacctatgagcagaaggtcttcgaggacctcgcatcgagggatgctgccttctccaaggagatgtccgtcgcctctaccgacaacgagaagaagatcaaggggatgatcgccaatccgtcccgtcatggattgacccagctgatgaacgacatcgccgacgcattggtcgccgagggtttcatcgaggtccgtacgcccatattcatatcgaaggatgcgctggcacgtatgaccatcaccgaggacaagccccttttcaagcaggtcttctggatcgacgagaaaagggcgctcaggcctatgctggcacctaacctttattccgtcatgagggacctgagggaccatacggacggtccggtgaagatcttcgagatgggttcctgcttcaggaaggagtcccacagcgggatgcatctggaggagttcaccatgctgaacctcgtggacatgggtccccgcggagacgccacggaggtcctgaagaactacatatcggtcgtgatgaaggcggccggtctcccggactacgacctcgtacaggaggagtccgacgtatacaaggagaccatagacgtggagatcaacggtcaggaggtctgttccgcagccgtcggtccacactatctcgatgcggcccacgatgtccacgagccttggtccggagcgggattcggtctcgaacgcctgctgaccatcagggagaagtacagcaccgtgaagaagggaggagccagcatcagctacctcaacggtgcgaagatcaactgaagcttacataggtccctgcaaggggatacggaagagagaaacagcgaaagaaggaatagaaatgagcgtgaggagggagtagactgaaattgggtattgttggaggtgccctgcagggtattgaggcggcctacctggccaggaaggcaggttatgagaccgtcgtcttggacaggagagaggacgccccggcgcgctccctcgccgacagctccgtgaccgtcaatgtggtcgaggagccggaaaaagcgaagaagatactcgccgactgtgacgccgtcataccggcgctggaggagatggatgccctggtggcactcgactccatgaaggaatatttcggcgggccgttccttttcgacctgaagtcttataacatctcttcgtccaagcagaggtcgaacgagatcatgggcaggtacggcgtccccatgcctaggccgtggcccgaatgcggtttcccggccatcgtcaagccgtcttgtcaaagcggttccgtaggtgtctccgaggtggagaacaaggagcagatggatgccgccctgaaaagagtggaggagctgggggacacacccgtcatacaggagttcgtccacgggaagagcatatcgatagaggtcatcggcaacgggacctccgcccgttcatacataaccacggaggtcgtcctcgaccgcaattacgactgtaagcaggtactctgccacccggggatcctctccgaggaggaggatacgaggttcgggctctgtgcgaagatgaccgcagaggacatgggtctcaacggactcatggacatggaggccatagacacacccaacggattccgtgtcctggagatagacgcccgcatacctagtcagaccccggcctgcatactggcgggaacgggcatcaatcttctggatgagctttacagggcctgcagcgggaaggaatccgctgcgaagaaacagcccggggcatcctcctacgagcatttccatatcgtaggggacaggatgtacaccacaggcgagaaggagttctcccacgtgagcgacccgcagtactgcgagggtcttttcggttccgacgagatgatcaccgactaccgtcccggtaagagcgagtggagatgcaccatgataacccacgggaaggacaaggacgaggtcttctggaagaggaaggatgccatcaaggccatcatggacgagtgccagatcgacgaatacatcgacctttccccggaggtggtctgaacgaccagactcacccccaacatgatatcgggcctctcggacgggctcagcgacatagaccggatgctcatgagggacaccgggatgaacctgctgaccctcggattccgtgccataggggcggacgcctccgaagtggacgtcaaaagattcaaggccgcatcggtgcctataacatcgggtctcggtataatcggcggtttctccagatctgtggcggatatcgtccgcgacatggggatcgactgtttcgtgaccgagcatactgacgtctggggcttcggagaggccatcgacagaggggccgacataatactgatggccgacgacgagcagtacatggcatacagcgtcgccgccggaagatacgccaacaactcgttctgtaccgcggctggctatgtggaagccctcaggggtgccgtgggcggcctgcaggggaaggaggtgttcgtccgcggggccggaagggtcgggagcaacatggtctccctgctctgcgcccaaggtgccagaccgatagtcgcggacgtcatcagggagaaggcggaggccgtggcgagggcgaatccgggtgctacagcagcagaggacctggaggaggccaccgccgaggccggactgatactcaacgcgtcaccggttccgatacccggtgacttgatacgggagggggcggtggtgtccacaccgggcataccgcatgtgtacgacgaggccaccctcaggaaggccaagttcatccacgacccgctcgccatcggtacggcaccgatggtggcccagtgtatcatctataccatggataaggagagagaacaatgaccgaatacggaattgcattggatataggaactagcggtctccgctgtcaggcgatagacctggagaccggagagaccgtggcgaccgccataacgcagcgtcatcccattcccgggatgaacgtcatcgaccacgtcaacttcgcattgaaatccggggaggacgtcgcgaacaaactcctcatcgggtgtgccaaccagctgttcgcctccctcggcatagacctgtcgaaggtcaagagggtgggtgtgtgcgggaacacgttccagatgtcgctgttccagaacatcgagatcagggacctggcgtacgccggggagaacatgctcagagaactgggcgtcgtccctccgaagagggacggggccatcctgaaggcctccgacatgggccttctgggtatgcccgatgcggaggtcatcatacctcccgccgtcaggcacgagatcggtgcggacgccatcgccatgctcctcatcaccggtgtcgccgactccaaagagccgtgcctcgtcgtcgactacgggaccaacgccgagatggccctcatctgcggtgacggcaggataatcaccggttccgccgccgccggacccgccatggagggacaggagatcgagagaggtatgcttgcggcccccggtgcgatatccgatgtggatatcgacggggacggatggaaatgcaccgtcctcgaccagtccatgatcgacagggacggggacaccgtggatcccatgaccggcaggtctctgaagaaaggggaggcggaggccatcggtatcaccggtaccggtaccgtagcggccctttacaacggtatcaagaccggcatcatcgtccctccgaagatcaacaccgaggatgggaagctgcatctccagaacggcatagacataacgtcccacgacgtcgacgaggccggtaaggccatcggtgccatgagggcaggtttcctcacccttctccatgaggccggtatgtggaccggggatgtcaagatagcctacatgtccggtgcgtccggactctatgtggatgccataaaggcactcgggatcggcatggtcgtccccggggccacccggctcatccagttcggaaacacgtccatagagatggccaggcgcatagccatgggcaaggtgaacatggacgacctgaagtccttcgcgcagaagctgaaggcggaacactgtatgttcgccacctcggagaccttcaagcagctctactccatcgagtacgccgtctggtgcaccagcatgcccatgagcatgtacaacgagatgctggatgtctaccagcttccgcacctcagcgagccctccgaggaagtgacggtggaaaggaggtccatgaccgaccttccggacaccgacaaatgtcctgtgaaggtgttcgagtcgggcacgtatctcacatacgaggtcgaaggatgcatattctgcaagaagtgcgtcaaggagtgtcccgagaaagctctggacatggtgaagaagggagacaaggtctactgccgcgtaagttccgaccgctgcggcggaaccgcctgcaggcgctgcgagcgtgcctgccccaagaacgtcctccacctcgatctcgccaaggtagagcagtgaggaggggtccgggaccgtccgaaaggacggtcccgtccccgtatcattcctcttcgggaagtattttccatccctctttaaaaacacatataaacaggttcttaatatccaaccccaagaacgttaatggtgtccgcggccgtcgcggaccgttttaattttctattcatctcaaaagagaaaagtgaaagctatgacagaaggcaagtttgaggatctaggcatctcggaagacgttctgagggccgtcaggtccatagggtggacggaacccaccccggtccagattgccgccatcccggtaggcctagagggggcggacctcctcgcgcaggcacagaccgggaccggaaagaccggtacatacggttccatcatcctgagtaaaaccatgtcgggcggtacagacccctcggcgttggttctcgtgcctactagggagcttgcaacacaagtgtgcgaccagatcgacgctttgtcgcagttcagcggccataaatgtttccccgtatacggcggagtcaacatagagaaccaagtcaaacaacttaaaaaaggggcggacatcctcgtcgcgaccccaggcaggctcaaagacctattggagaggaaggagatctctctctcctcgatatccatagtagtcctcgacgaggcggaccgcatgctggacatgggattcgcacccagcgtgaacatgatcctttccaaggtcccgaagaagaggcagaccatgatgttctccgccaccatggaggacgacatcaagaagctcgctgtgaaacacatgatcaatcacagggagctgctcatatccaaggacgaaccgaccctcgacctgaccgcgcagtacttcataatgaccactcgcgagtcgaagagggatgaactcgtccacatcatcgaggacggatatcccaagatgatcgtgttctgcaagaccaagaggaaggtcgactacctgttccgtaagatgaagagggacgagtacagcgtctgcgagatccatggggacatggtgcagaacaagagggagaagaccctccgctcgttcgttgacggtgatgtggaggtcctcatcgcatccgatgtggccgccagaggcctggacatcatcgatgtggatgtggtcgtcaactacgatgtaccggccgatgtggaatcgtatatccataggataggaaggaccggaagggccggaaagaacggaagggccatcactttcgtcaccgaagacgatatcaagatgctcaacgcgatcgagaagaaggtcggcaggaggatcgtcgagatcgctcccacctcctctcaatacagcgaagggccgaagcccgacgagactcccaaggcccgggcgaagcagatcaaacagaagcaggcggccaagaaggtcgcggccgagaccgcactcaaggcggagaccgtgaaaaaggagcctaagcaggtccctgtgaagaagaagttccaggaagaggttccggcggagacctccggacgtaccctcaagggcagattggacagaaggaaccgcacgaaggccgagatcgaggacggggccgtagcacccaagaaggccaaacccgccgtctccaagaagcagccggcccaggctccggcgaagacacccaagacccaggagcccaagagggaggggcagccctccaacggccagaggacccagtatcccaagcctcagggcataccggagcatccgaagcctctgcactcgtatgtcaagatcgacaaggcactccctccggagaaggatatgtccttcgacaggatcgagataagcatcggatcagacgatggggtcgatcagcagaaactggtcaaattcgtcaccaagacatccggcatccgtactcaggacatcgggaacatacacatctatgagaacaagtccagagtacaggtcgtcaggtggaggtcccaggaggtcgtggacgaacttttcggccagacctacaacggcagacgcgtgatggtctacaacctcagcgacaaacagtgacggaatacgggtccgggagggatcgtacctcccggacccgttcattccttttcatcgaaacggccggtaaggtcatccagcaccagatatctggcactcaggatgtcggccagtcttttggcgtagtttatgcgacggtattttttaccgttgtctatcaggatccattcggtgttgggtatcttcatgatggcggcgatcctcttcagttccgcccacggctcatatccttcgaccaccggcctgtcggcctccgcatctgttatcagtatgatgaagcacttttcgtcgggattcttcctgacatagttcgtcatatacttgtttatggtgaggagggcctctcccagaggggtggatccgccggtgacggtccttctgagactttcgaagacattctccacattgcgggtgaacggtacggcgaggttgatgatattctgtccgaatgtcagcagtgccacgcggtccctgcggacgtatccgtcctccagcatcgccctcacccctttgatggcctcgtcgagggccccggtgttgacgagggatccgctgacgtcgacggcgaagaggaacgagcaggagctctgcttcgtccttatgttctcacgtatgtcgtccggtacgatggttatgctgaggccgttggaacgtctcgtcttctgatacggtgcggcggcgcgtatggtcgcacccagggccgggtcggaggtcctcccctccggtatgcggaatccgctggcgcgcccgttgcggttgctgctgttgacccctctgggtatgtggcccaccacgctgttgagacggatcgattctatgcggtctatctccgccaggtcgttccgtacctcgtccaggaccatagtgagtacgtctacatcggggatggcggcatcgtccgtgtcggaagtgtccggatccggatcgtcctgctgtgtctgggtcatgtctgcggatgtctcgggctgcatggcctcgaccctttcgatctccttctggacgtccagtccttcgtcggccgacatctttgtcaatttggcgatctccgtgttggagatatccatgtcgtcatcggagatctccgcatctggcacatcgtcggatgtcacggatgcgtccccttttgtcttggatttgagcttgggcttcctcctgtgcaggaggcacatgaccgatgcatcgcgtatgtcgtcggcggttatcctgtccctcccgtccaaggcacacaggggccctggccactctggcgcatgcgaggtccccgcggtggcctacggcgttcatctttgtgcatatggtcacgatgtcctggatgtcgcgacgtgtgacctttatggaaggtatcagggatctggcacattctatcttatgccttacctccgcatcatcccccacgaacctcctggcgaaggattccgggtccctgtcgaaatccagtacgcttgccaccacgtctccgcgtttgaccgcatccgtctccaccgtcatcgagacacagatgtcgaatctatcggccacggattcgggcaggtccctctccagagggtccatggtggcgacaacggaggcggaacagggatattcggcggatatgccctccctttctatcttcacagtgccagacgacagcgatcccatgatcgagttgagggtcctcgggtccaggaggtttatgttgtctatgcagaggatgttcccgtccgcacggctcagtatacctcccttcatcaccgacgatccgtctttgacggccctctcgaaatcgatcccgccgaatatgtcctcgtctcccgttccggccgggaggtcgacgatggacctgtccgtaagggcggtcatggatctcacgaggacgcttttggccgtcccggagggaccttttatgagcactccgttgagacggtcgtcggccaggaggcacatgagcgctcttttggccgtgatctcccccatgacggcggagaagggataggtcagatttcctctagacatctgtgaacatcgtccaggtcgtagtcggatgtcttctcgaagggcttcttcttgagcctatgtcccagtacgagggatgccaccgcctcgaggtcggccttggtgacctgcctcctcccctcgtatgccgcattggccctggcggacctgatcatggtgatatccgccctgtgcccttccattccgaaatagacggataggtaggcggccgcgtctatgatcttcctgtcgacctctatatccttgatgagtgcgcgggcattggctatcccatcccttatccttgcggtctcctcctcataggatgcggtgaacgttttggggtcctggtcgaactgcagccttctggacacgacctcgctgcgctgtgccagatccctttctcctttgacctcgaccgacattccgaacctgtccaggagctggggtctgaggtccccctcctccgggttcatggatccgacgaggacgaagcgtgccgggtgggtgaatgagaccccctccctctcgacgtagttggtccccatggcggcggagtccagaagcatgtcgactatgtagtcctccagaaggttgatctcgtctacgtacagcaggttgccgttggcctgtgccagtatacccggttcgaacttcttcttcccggtctggaggacggcttccagatccagcgtcccggcgaccctgtcctcggtggcgctcagcgggagctctatgacatcggtggggacggtctccgtctccagtttctctcctgcggcggccttctcggcgcaataggggcagaatccctcggggcgtctgggatcgcagtggaagggacatcccttgacgacctccttcttcgggagtacctgctccaaggagcgtatggtggtcgatttggcggtacccttctccccctttatgaggacccctccgatccccgggtcaataacgttcaggatcagggccttcttcataaggtcctggccgactatagcggcgaacggaaacatcattgcatgtctgctggccatttttatcacattcggctttcggtgagccttaaccgaatgcttcataaaacgatatgtaataaaacatcgggtggttggattgggaataagtgatccgatgaaccctcggaccaggtatcgccgacagatggagagcgtcatatcgaaggtcatcgagggcatgtcggagagtatggaggacaaagccgtctgtgggtgagatgatgggggacgggcttggatggtattccgaacagagcccgtccgacaatatcgtcataggattcccgctccggtcatcagggcctcctcctcagttttccgaatatcctcccgtcttttccaacggatgatacttcctgatattttatcgtgacatcgcgcttggcctgtatcttcttctgcctgcggccgttgaagacgacggcccaagggccacgtatctcctttgcattgacagttgcaatattggtctttacaacctccttggacccagaattatccagatttctaaccttcttccaggaaccgggcttttcgtattctatggtgacgttctttctgaccttgcgggtctgaccctcatggtttccggtctgcatattgacatcttcctcggagatatcgtcgccatagacatccgcccttctggtacggatgatcccgaaggacaaggtcaccaatcctctccgtagcagtacctgtcggccgtttcactatcgacgccgtagcgttcaagatcggatccatctagatggtcgccgtcatccaatttggattcggcataggagacgatcttcgacagccattcttcggagggtttctccccacggtcgtacagatagtgcgaagcgccgtctttggagatttcgtcgagcagcctgcacatgttgcgcatggcacgtctcgacttcaccagctcgatgattagttcgtccttggacagcttctccagctcttcccattcgcttgccattcctttctcacctccttttacaatagatgtgtatcctttaccatatctcagattcaaaaatctgccccctccacacagatatgccgttgatcgccgtatggatctcggtgagatgctcctcaccctcgttcaatctcatggaggatgccatcaggtgcttgttaagtttggacatctgtttgaggaattgctcggagaattcgacggggtagatcaacctatatccttcaagatcctcatcgcatcggagaaggagtaggtcttctggtccttgaggaactctttttacgcaagttcgccgacggcggacagatacagcaggatcttcagcatattcctttccggggatcaatccacccagagatacggtgcgcgctcgtctgacggatcttcccaggtctggtgaatccgtccgcgtgtatggaggctttggaagccacgatctttctggaagagcgtgacattttcaacactccctccaaagtttttccgccgtttccagatccacgccgtactccgcaaggtccatgtagctgaaatcatccgtatgggccttggcgtatgcgactatcttcccgagccactcttcggtcggtttctcaccgagatcaggtatcgcccagcgggagccgtccctggcgagggattccaccgtagctacgaactccgcatgtctggtctctgcctcgaccaacctgatgaccaattcgtccttggacatctcggcataagtctcccatttcgtcctcttctccgtattctcacctccctttacagtcgatgtgtgtcctttacacatcggggattcaaaacagttgccacagtctgcggcggcagtcctcatttcgagacccccgcacgtctcaggaaatcctccccggagggagtgatcctccacaggtagacaaccccgtccgtcttcgtcctctccaggtatccgcagtcggccagggcgtccaaaatgcctctgcagtctttcccggagaccccgagttccttcagatgtgtgttgaaactgctggtcttgacaaaactgttcttctttgcgaacgcgagaatcgtcgcaatttttccttcgctcatatttccagctcctttttccgaggagggcgaaaaggtggtagggggcccggagcacggcacaagaattggacgatgcgtgccttaaagcccggacctgtccttcctcctgtggaacagttcgtcctccggacagtattcgtagtcgccctcctcccattcgtcctcgtccagaagatacacctcgggacggcctccgcctatgcgtttcatgtagacggcgtcttcgtggagttccgctatgcagtcggtaaagatttcgtcctccccggcctctacgatcttccgcagaccggagttgatggtccgcacgaaatcctccggggtcttgttgtggcctatcgtccatctgagcatcagattcccgcgggggtctatgtggatcatcgtgaagatgctggcctcatccttggtgagacccagtctctcgaatctctcgcggtcgtgcctttctatctcttcgatcgtgttcatatggaggctcatttcctcttcgacggaaaagatgcagcctatgagatgcaggtttattagcaatccaatccattttagcaaacgtgggattggtaatgatcgtatttctggaggagatgtgacgtttggaagaagaaagaaaaacccccgtctcagctattccggaggggagaggccgaaaaagaccaaagagtatgttcttaaaaagagcgataaaaccaaagaagacaaacctgtcgcgaaaaagaagtaaggggcctcgtgggggtggcgctcacctgccccattaagcatgacgattcaatcgttcgatcaaatccgcacgagagcaattattgattattttcgggttatttatttttttatttctcttcgttgagcgtatgtactcctttggatccattgcccgtattccatattttttctcatttcttccttatttacccttttacggaacaatttatccattgtcacaatgattctactgtctgtttttacagcttcatccattattcttttgtcgccaggtccttttggcggatacttagataattcttcatcagttgcatgtttgactttaacaatgttgtttttctgacgatttctaaatctttgaatccgagatagggccttcggaccgtccccatgatatctgctgagtttcacggccgtcagggcgacggcggacagacacagcaggatcttcagcatattcctttccggggatcaatccacccagagatacggtgcgctctcgacgtacggcttgatcatttccagcacgggggccttgcattcgcttatcttcttcagggccttcttcttgatggaatagatggcctggcgggatttgttgatggtagcctcgcctaggttgaaatgatagacccagaggtacgtcgtggcctcgttgaacgtgaggccggcgtagctctgcagtatgtacgtgcatatggcgaattccttttctccggggagcagatcggtagatttcattgtcatcacatgtaaaccaaatagtttacatgtattagtttattttccgtccgcgtcttttttcttgatgacacggacaccgcgagcctcgatctcgacaggctctttgtccgattcggggcccgaaaaaacggttccgggagacggacgtctgtccgtacccccgaatccttgtgttgctttgtgacggtgatcttcactcttccgctggcggtcatcctgtttccgccatgggtgtttctcgcatggaagtatccgccgttctctatttcgtccgcctttactctgacggattcggcctcgatgtcgggtttgcggcgggaggtcattctttcccctcctggccgacatcgatctcggttccttcgggaaccttgagcttcccctcggcactgagcttctgacataccgagtacgcctggtcttcggtaaggccgtagtccatgaggtcgcaccagcagaacagtccgtccttgggatgcatcgccccgtattgggcgatcttttcagcccacttctttgtggtcggttccccgggttcgtcaccggtcatcttcggtttgaccgcataccagggacagtttttgtcccccttttcatcgcgcagggttgcatagaggttcttccagagaaccagctgtatgatcagttcgtccttgctcagtttctcgagctcttcccattcgcttgccatcttcttctcacctccttttacagtcgttgtaccttcggagcatattccgggttcaagtgctttgcccatttcttcacctccttcatggcggtgcggacgcactccgggcagaagcagaggtcgagatgcacgcgggggacggaggcgaaggcccatccctcggcacggccgaactccctggcctccctcgaagaggaggtggggaaggcgacggccccgaaacatccgcaggaggacccgtcgcattccaggacggtgtcgttccgggagacgatcattcctccccctccgcgaacatggcgtccttctcggaacccgacggtccgcagacctcctccgggccctcggcgagctccgccccgcagaaggggcagaagcggatggggacgaactcggtgtcccactcctcctcgatcggttcgttgtatccgtcgccggtgaccgagcagatcccgaccgacaggaggaagcgtccctcgtcgaggcagacggatgatccgaaggcctcccggaaaccctggcagcagtccccccttgcagaagtaatccccgaagctctcgccgtcggagcagtagctgaccgtgtgtcttccgctcatgcgctcaccccagataggcggagtccggatccgagaggtccatccagagccggcggacgaagtcctccagcatttcctccagctcctccttcttctccatggacagatagggggcccagacggagacgcggacgagttccgcgctgttccccagacattccatggttatggccttggccatggtctcccggctttgcgtagctgtcgctgcagctgttctttgtgtcatttggctttcctacaagtttaaaacttgcaataatttgtacgaatttggtaggatataagcatttccacaagttattgcaagtaatggcaagaaccgaagggcgcaggaaaccatacatcacagtaacaattccgcctgaactcctcgaatatctggagaaaaaggtggagtcgagagagtttgcaagtctagcacacgggattgaagtgtgtgttttgaggtataaagaggccgaggaaagaggggagaggccgtgaggaattttaggaaagccaatccgtaaaaattgaaccccactggcctcgtttttattctctgcatccccatgggggatgcagtctttaatcctgttgattgaagagaagatcatctcttcaacctcctgataaggatcttcacatcatccttgacgtttacttcgaaacgtttcggattattcttggaaggatggggtttgttgacggtcctggcagagatgtctgcggaatccccatcgatctccgttccatcgttcggacgcgatggattatcgtttgagttcggatattgggtttcgatgtggactctgacattccctttggcacttgcgcccattgcgttatgagtgccggtttggcggtgttttccaccgttcgaatggatttttatgctatccgcactgattcttgcacggaacgcctcaatgaggcccgggccgtccgaagacggcttctttccggacctcattcgtctccctccgggggaagaagatcgtcgtattctttcccgaattcctcggcaagggacttcagggcggattcgagttttccgcgtttctttccgatctcggcgatcctgtcttcgagctctttctcggacagggattcgagatcgtcccagtcgcctttgatcttgggatcttcgggccattcggggtctttttcttcttcttcgagatatatgccgtggttggggctttcctcgtaatcgtaaggccataccgcctccccttccctgcacatcttctcgaatccggaatacgcgcagtcggattcgacgccgtaatccatgaggtcggatccgcagaaacccaggtctttggggtcgcggtgctcccatgcgtatctggcgatcttcttcagccacttctccgaagggaccctcagaagcccgctgtcgaacgttcccctgatggaaaacccggagaggtccttcagacaacctgcgaaaacagccatctggtatctttcggaaacgtatctgatgatcagttcgtccttgtatgtgatcttctcttcgtccattcttttttcacctccttttacagtcgttgcttcttcggagcaccttccgtgttcaagtgctttgctcattctttcgcctccggaacgatgctgcggatccattcggaatcgagggagtagaagtcggtgtgacgccactctctgctttcccagtcgtgtgtccttccggtggccatggtcccgacgcggacgagagccgcgggcttcaggtcgtccatcgtcatcttcttcaggacgggctccgcggcacggagggattcggaggagcggacgtagaaaaggatcctctccttcgtccaataggacatggggagcttggcatcctcgggggtcttggcgccccagaggtcgtacatcctctcgagctcctgcccctcgaggtcaccaagagcggtcacgaggcgggccatggggtcgtcgaagtcggcggcggtccagaacagggggtggctcattccggcacctccccggggtagaggcctttgccgatcagcgcgaggagaacgtggcctgcgacagctgcatcggacatcgcgcggtgcttctcggggccgttgagccctgcagggtcgtcgggacagaggaccctgtacgagttctccagggatgcgtagcagttcccgtcgttgtggcggcggcgcgggatcgaaggatcctcggtggcggccatcatgatgtcgggaagaaggcggacatcgagattccagggctcgtggtcgaggaagagcccgaaatcgaacggagtattgaacgaggtcgtcggagtcccgttaatgaagcggcggaccttatccgcgacgagatgcgcgtcgggtccgttctccacttcttcaggagtgaggtcggtgtgctggaagacccagctttccgcctgcgtcttggtgagcttggcgcctacgagggactcgtagaagggagagacggtcttcttcactgtgtcgacctgtacgatccctatctcgacgacgagatctcccccgagagctccgttcagcccggtggtctcggtgtcgatgacgttgacgatcattcgaccgcctccctcggtttgatggtgatcgttttgccgtcgctgaggcagatgtcgagggttccggacatgtggtggttgatcttcaccacggttccttcgcagatgctggaagtggccttgacggtcggtttcttcctcgatttggtgtagaacaggacctcgcgggcgcgccagccgatgaagaccttgaagttgacgatgaggcccgcttcgtcgatgtcgcggcgctcttcttccggagggaagaagaaggtggcgacgcccttattgtcgcttgtcccggcaagcgcggttcccatgaggtcggccatgcggccgatcgtctcggcatcgaggacgtatgcgctcaaatgcgcaccccctttgccatgcgaccgaccaccctgatggacagaacggcgtagccctcggggatgccgtcggcgaaatccgcatggcggaggatgtagacgaccgcgaccttgcattggcgtccggtgtggccggagccgggacgccattcgcagagagtcagtgtgtccccgatatggaacatgcggtcgtcctctctgcgaagctcgaacgtcttgcggccgtcgaccaccgcctgaaagaactgcggcaggatcttgagatcgtggcacgtcatgcgcgcacccccttcgccgtcaggcgggacaggaaggcgtcgcgggggttgtcatagatctccctccatctgaagcacgatccgcatctgcagtcggagacgacgtcaggggtcccggcgcagcacgcgagaccgtccttgagggggcatgcgacgagccgtattccggtcagaataaagcccccgcggaatattcaaaattttcaaagctggccgaaatcattgagccggggattccgactgctggataagggttgtaggtgcggacgccgggattcgaacccgagttctaaccttggcaaggttaagtgataaccagctacaccacgtccacacgtgtaaacaagggaatgacttatcagatataaaggttttgaatggccggtccgccggcaaagcggagtctggcacattcagttcctgtacaatatcctgtcctgatgaaccggctcgcaggtgacgtttatccccagtttcctgaggacggagttgtcctgcggatagaggacgacggacccatggaggtcgcatcctctgagcttcttcaacttgctgaacgccctttcagactcggtgctggtcttggcgcttatggccaaagcgatgagcatctcgtccgccctgagcttggtatcgtttccgaggacgtccgtcctgaggatctccacctgcttgagtgtctcgggagggatggggttgaagttcccatccaccgcggcgatgaccttgatcgcattgaggatggcagcagacaccgcgctcaggttcccggtggcctttccggtgacgacggtgccgtcggggagttctattccggccaccgggccgtcagccccatcagcctgtctcctcacttccctgtacaggaggaagttctcgggagacgtctccgccttcttcatgaggaggtccaccctggatacgacgtccgccggcacctttccgtcgagatggtcgcatgccacacggaagtatctcctgacgatctcccttctggatgcctcctgcaccgcagcgtcgtccgatatgcagaatcctacggtgttcacccccatgtcggtgggggacctgtatggcgagtggcccatgacgccgtcgagtatggtcttcagtacggggaacgtctccacgtcgcggttgtagttgatggcgctcttcccataggcctccatatggaacgggtcgatcatattgacgtcgccgaggtcggcggtggcggcctcgtaggccaggttgacggggtggttgagggggaggctccaaacggggaacgtctcgaatttggcataaccggatttgatccccctcctgccgtcctggtatatctgtgacaggcagacggccatcttcccgcttcccggtccgggtcccgtgacgaggacgatcggcatgtccgtggatacatagtcgttcttcccgtacccttcgtcgctgactatgaggccggtgttggtggggtatccgggtatggggcggtggagactcacattgatgttcctctccttaaggagtctgacgaaggaatcggcggccggctggccggtgtacatggtgaggacgatgttatcggccttgatgccgtagctgcggtagaggtccaccatgcggagggcttccaggtcgtaggtgatcccgatgtcccctctgaccttgctcttctctatgtcgttgcagttgacgcagatgacggcctcgagttcgtccttcatggtggagagcatgcggatcttgctgtcgggcctgaatccggggagtacccttgcggcgtggtagtcgtcgaagatctttccgccgatctccatatacaatttcccgccgaacttccccagtctgttccttatctcgtccgcctgcatcctggcatatttctctccgtcgaatccggtcgccgccatggtaaataccgattgtcttacaggtcattattaaaaatatcttttggtccccttccgatcccgggttcctttccgggtcgattgcaaactatgaatacgtattatcgtctgcacgcatacatggaaaagaccaaccccatgaggatattggacaaggcggggataccttacgaggtacacgactacacatcctccggtgcgatcgcaggcgcagatgtggcggcggccatgggcgaggatcccgaagaggtcttcaagaccctggtgacccaggggaggtcggagaggtattacgtcttcgtcgttccggtggatagggaattggatctgaagaaggccgctgcgagcgtaggggagaagtccgtggagatgataaggtcgaaggatctcctgcctaccacaggatacgtccacgggggatgttcccctctgggtatgaggaagcagctccggacggtcatagattcgtccgccgcggagcatgaaaggttctatgtgagcggagggaaggtcgggctgcagatcgagatggatttcgccgacctgcggaaggtgctcgattaccgtctcgccgacatatcccggtgatcagtccctctccaggaccttcaccgagaccttctttccacggtatctcatcttggggacgtccatgagcatcctgttgccgaagtccttgtggacctcgacggtggagctctcctccccgatctttatcttgccgatggcggcgtcgattatcctgcccgcacgcatgatgtagtcggccagtttcaccttgccgatgccgtccgccttcccgaggccgacctcgaacatcaccatcccgaaggggtccgagagttggtcgtagtcggttactttgcggatggtgtccttggacccttcctccgcttccggaacgtccctcttctcgatcttcatgccggtcctcagttcgaactcgcggatcaggtattcctcctcggaggtgacgaacgatacggccgtcccttccctgcctgcacgcccggtcctgccgatcctgtggatataggtgtggatgtcgtccggcatatcgtagttgatgacatacgatatgtcgtcgatgtccagtcccctggcggcgacgtcggtggcgatcagcaggtcggtctcgccttccttgaagtcgtccacgaccctctccctcttcttctggggcatgtccccgtggagggcctccaccttgtagtggtgctccttcagcctctgttccaggatgtcgaccatcttgatggtctgacagaatatcagggccttgggttcgtctatgtcgaggatcctggtgagtgcccaggatttgttcctccttccgacggagatgtagtattccttgatgaggtcgaggacgacctcgtcctgggagacgttgatctccttgggctttttcatgtaatcggtggccagcctctttatgtcctccggcatggtggcggagaacatgagcatctgcctgtcggccgggcactgtttgaatatgaattctatgtcgtcgatgaaacccatgtcgagcatgcggtccgactcgtccatgacgatcacctttatcctggacagatccagatattccctctcgatcatgtccttgacgcggccgggggtacccgctatgatgtccacgccctcctccaactcgtcgacctgcctctctatgctcgcccctccgtagatggggacgcatacgtgtccgctgaagtcggacatctttccgagttcctcggagacctggacggccaactccctggtgggttcgaggacgatggcggacgggaccttctgtccgctgggtatggtgctgagtatcaccgagccgaaggttccggtcttcccggtaccggtctgtgcctgggctatgaggtcgtatcccttcagtccggcggggatcgccgcctcctgtatgggcgaaggttcttcccagcccatctcgtctatcgcttttgccacgttctcggctatgccgagatccaagaacttcgagatcattttccatcacgtgatctgaccttacagcctgcgacctatccgcagacaacagtcattttcggacatccgtatcgaaggagttcttatatacgtatgccccgggaaaaatccctgtccgtatctggtactgtattctttgtaccgtcatcaagagaatgacccaccacattacaaaacgcaacgtagtggtttctctccaatttatatatgggacggtagtttttcagccccatggcgaaatacgaatgcaccatgtgcggttatgtatacgatgaagccaaagggatacctaatgcggacatcccccctggaaccaagtgggaggacctccccgacgactggacctgcccgatgtgcggatccacgaaggacatgttccagaagatagaggattgaatttggccaagtacgtctgcaccatgtgcggtttctcgtaccgcgaggataaagggaggccgagcgaagggatcgcagaggggaccgtctgggacgatgtgccagacgattggaagtgcccgatgtgcggatcccccaggaacatcttcaggctctacagggacgagtacttcgaatgatgcggacggaacgcccaatcatgaatggagagatatcatggcgaaatacgagtgtactctgtgcggatacatctatgacgaggagaaggaaggcgtgaagttcgccgacctccccgacgactggacctgcccggactgtggtgccgataagagcaatttcgaactgaaggagtaaaatccttcttttctaaacatcttcaaaacctgttattttcctgtctggcacattgtcttctcataagttaccgctaggtaactatacaaatgatagtattatatatcctgtagagtgtgatgggatatactatgtcgatcgtagcaatcgtatcaagccctcgtaagaatgcgaacaccgatttccttgtgaatgccgtcgcagaaggcgccaaggagaacggaaaggatgtgcagaccttctacctcaacaccctcaaggacaagaaaggatgccaaggatgcgatgcctgcaagaagaacggcggtacttgtgtgaccaaggacgatctcacacccgtcctcgacgccatcagggatgcggagggtatcgtcctctcctcccccgtatatttcggagaggcctgcggtcagtacaggatgttggaggacaggctgtacggattcctgaaggccgatttcagcgtcagcttcgaggcaggtaagaaagtggccgtaataaccgccgccggttccgccggagcggatgcccttgcagacaagatcgaagggaccatgaagaactacttcaagtgcgaacccatcggcaagatcgccgtcgtgacccacaacgacaggaagttctccgagaacgatgccgatctggtcgcacaggccaaggcgctcggaaagaagttctgaaactgtaaccaggagggggatcgccccctcctgttcttatttaaaagatccccccggatcccgggggtggtgtttcactgctcgatggcgagcagggcgttgccgcactgtacggtggagacctctcttccgtcgagggacagggatttctggacgtcgaagaactcgggccccatctctactttctggccgtcgacatcgaggacgaccttaccctcggagatctgtttcgcgaggtcgtcggcggacgtttttccgagagcggccacgatggccttcgcctgtcccttgaatgcaggacccagcttggcatatacgggcttgacggaggcgaccttctcgatgaggtcggcactttccgcgatgaccaattccttggcccttgcaccctgtctgatgtcctcctcggacatcctgtacatggcggagtcccctccgatgatctccagtctggatatgtcggcgttgatgttgatcttcctctcggccttccaggcgcggacggtggcgatgaactcggcggccgcatctccggcctccagggccccggcgtcgatgtccatgggttcgggccagggggtgagatggatcgatttggcaccgtcgaacttggcgtaatgggtctggtagacctcttcagttatgtgcggcatgaaaggtgccagcagtttgacggcgttcaggaagacggtgtaaagcgtgtatctgaccgcatcgtcgtccctgctcttgaccatctcgacgtagtcgtcggcgaacacgtgccagatgaagtcctcgacgaatttcatggccttgtcgaactgatatatctcgaagttctcggtgacgttcttgatcgtctgggacagttttccgatgatccacttgtccgcggtcctgagctccgcaggcttctcgggagccgtctgaaggccctcgaagtacctgctgacgaactgtccgaggttgtagacctttatgcagatcttctttccgcggacgacgtccttctccctgaaggcgtggtctattccgagggagcaggtggccgcatagtatctgagggcgtccgcaccgtagttctccaggatgggtatggggtcgatgacgttcccggcggatgtgtgcatgggggttccgtcgggggccattatgaatccatggatcatgatgtccttccacggtttggattcctcgatctgttccgccctgagaatggagtagaacgcccaagtcctgatgatgtcgtggctctggggcctgagggacatggggaagagcttcttgtggagctcggggtccctctcccagaacgtgttgtacagggacgatccggaggagtccatccatgtgtcgaatacgtcggtgcatccgacgagttcgccgccgcattcggggcacttgtcgaccggggccttgtccatggtggggtccacgtactttctggcctgttcctcggtggcgcagacggcgtgtccgcattttttacattcccatacggggatcggagtggcgaatatcctctgtctggagaggacccagtcccactccagggacttggtccagtcctcgagtctgaccttcatgaactcggggtaccagttgatctcgctggccctcttcaggatggcatccttgaaggtggtggtcttaaggaaccactgggggacctgcaggaactcgatgggtgccttgcatctccagcagacggagacctgctgggggttgtcctcctgttttacgagaactccggaggccttgaggtcctcgatgatctgtgcgcgggcatccgcaacgggcataccggcgtatttgccggccagttcggtcatcttgccctcttcgtcgatacccttctcgagctcgaggtggtacttcatgatccactcgaggtcgctcttgtccccgatggtgcagatcatgacgttcccggtaccgtaagtcatgtcgaccttgggatcggagatgatcttgacatgtctgccgtagatgggggttatgagctctttccctaccaggtccgccttctctttatcggcagggttgacggcgacgaccttgcaggtacagatcagctcggggcgggtggtggctatcatgacgtagtcgtcggtgccggcgatctggaacttgaggtagttgagtttgttgacgttttccttgtactcgacctcggcatcggcgagggccgtcatacatctgggacaccagttgacggggaagttggccttgtagacgaggccgcggttgaacagcttcacgaaggagagctgggtgatgctcctgtagtagggggcgtccgtctggtagtagatggacggatccatgctctccccgaggatctcgaagtgtttggtcatctgttcgatgaagccgttggcgtagtccgaacagagtttcctgtactcctgccggggcaggtcgagcttggtgatgttgtacttcttctccacacggacctcgataggggtaccgttgacgtcgaaacagagggggaagaagacgttgtagcccttcatcctcctgtagcgggcggcgaagtcgatgagcgagtatccggtggcgtgtccgaggtggaggttcccggatgtatatctgggcgggttgtcgatgctgaaaacgggcttgtcggatttggggtcgaagcggtagatggcctccttcttccacatctcctcccattttttctcgatctctgatgaatcgtatgccatggtaactgtggctgggtagaaagcgagagtataaataaaaaccctttaagagaacgcgcgactggggataaaggtatttggagagggcccggaggccctcttttttcaaggctttatcttcttccttctggagacgtggttgtccttctggtccttgaccagatcgcccagcttcttcaccaggtcgttgttggtctggacgatgtcccagcctatctccttggcgttgaacgtcctgccgttcacgaagagcttgcctatgaggctgtacttcttcttgtcaccggattcgttgtacctcgtgacgtggatggtcagggattccggcctgtggatcttgctgatcttggccatctccgccgctatgtcggagtacatcgcatcggcgtagatcttgtcctcttcgtcgaggccgctgatctggacgtagagctggtccctttccctgcaggccgagatcatctcgatgatgtcgtattcggtcaggatgccgaccatctcgtcgccgtccatcacgggcagggtggagatcttcttgctggccatgacatcggccgcactctccatatcgtcctcccaatccacggtcatcacgttggtgaccgcgaccgattccaccgggatctgcgtactcgggctcttggatatcccggccacggatctctcgccggccttccagccgttgtctatgacctccctcatccctacgacgccgaccaatgcccccgcactgtctatgacgggcatggtcctgatatccaggcgtctcatcgtatcgaccgcttcggacagcatggcgttgtccttcacgtactccacgggggtcgtcatgatctcccagaccttgacgtccttgagggacttcatgtccgccgctatctcgatcagggccgtcctggagactatgcccgtgatcttctttccgttgacgaccgccagctgcctgcagttgttggtcaccatgtattcggcgatcttcgtgatctccgtctcttccgatatggtcggaaggctcgataccagagacttgatcttggtctcgggtgtggcgctcttcttcctcagtatggtgccgtaacgcatcattccgatgtagctcccgttctcgacgacagggatctcctgatatccggtcttacgcataagtgccagactgtcggagagggtgtcgtcgggtccgagggtcggaaattccagttcgacgatgtcacttacggacagggagtctatctgggacttgagtatagaaagtttcttgagatcttcgagatcctttattcccacttcttttcaccccgtattaaacatcggcgtgctgacaatataaaggtaccttcgaagcgggacgcatatgcggtttccgggaccgttggctgtctggatagggaagaaatgggatcagaacggggttttggacacccgttctgaaaaagaaataaataggttcagaggtcggagaacttcttccccgcgaggagttcggagattatcgtctcggcgtcctcggcctttatcctcttctgctcggcggaatccctgtccctgagggtgacggtgcccttgttctccccgtcgagggtgtcatagtcgacggtgatgcaccacggggtaccggcctcgtccatacgggcgtatctcttgccgatggtcccggatccgtcatagtacgcctcgacgcggtgggtgtggatcttctcgcagaggtccttggcgaacgtatccagtccgtccttctccatgagcgggaacacccctaccttgatgggggccacctcgggtgcgagcctcagggtggtgtagtccttgtccttgtcgtaggagtatgcatgttccagtacggtgtagaatatcctgtcgagaccgtgggagggttcgatcacatggggtacgatcctctcgccggcgaccttctccttcaccttgacgacctcgaacatatcgccgtcgaggacgatctcctcgccgtccacgtcgatggagagttttccgtcggagatgtcggcgggggtcttggccgcgatggcgtcggagactgccttcgccttccccttgaacatcggaccgaccttcttggagttgggtctgaccttctcgacctcctcttcgcggggctcgtcgaatctcttgaagtgactgaggtccgcaccggagaactgggcgtgcctcgataggtcccagcatcctctgtccgctataccggtgatctcggtccatccgaacgacagcagcgcctcggcatcccagcagtcggccgcgtaatgggccatctcgtcctgcaggtgctgtctgaacctcagcctcgcagggtccactccggcacggacgaggagctgttttgtggtaccgacgaaatatcccaggacctcgttggcgatgatgtgcttctccaccgcctccccgaccgtcatggtgacggtctcggtgccggtgttggggagcagggtcaacacctcgtccttcatctggtcgaatctctcccagtgcttgtcctcagggtcgacgaagagttccacctccatctggttgaactccctcatcctgatcatgccctgcctgggggcgatctcgttcctgtagctccttccggtctgcatgaccccgagcgggagcttctccctgttgtatctgtagaggttcaggaagttgacgaagatcccctgggcggtctcgggtctgaggaatccgacgcgggacgacccgggtccgatgttggtcctgaacatcaggttgaaatcctccacgggtcccagcttcccgccgcattcgaggcagacgatatcgtggtctatgaacgcctggtcgagctccttttcggtcatgacgtcggggttctcgtagaactccttcaccaggtggtcggcgcggaagggcgagccgcatttggtacagtacgtgatcttgtcggcgaatttgtcgaggtgtccggacgccttgaagacgtcgcggggattgacggtctccgtgtcgatctccacgaacccctcgcggcctttgtataagctcctccagatctcgacgatgttgttcctcaggctgaatcccagaggaccgtagtcgtacattccggccacggagccgtagatctcgcacgacggccagatgaatcccctgcgtttgcacagggacattaggtcgtccgactcgttgctcactctaccgccccgatgatggcacggagcacatccacgtcgtagatcatgcccacgagctcgtccttggtcccgtggacggggacctgaccgaagtcgtttacgatcataatgcgggcgacctcgctgagcgaggtcttcctgaagaccgtggccggcttggggaccatgtagtccttgacggtcttgtcgttcgccaggtacttctcggtcgcggtgtagaacagaggcatgacgttcctgaggccgatgagcttggggtcctcgacaccgagcttcttcgccgcctcggcgtcggagatctggtcgctgaacaggtcacggtcggtgaggatgccggtcaggtcgccgttggcgtccaggacgggcacggcggcgacgtcgctgatcctcatggcgctcacgatgtacgtcagggggtctccctcgtacgcggtgacgcatgtggtgcggatgacgtcctccgccttcatgtccgtcttcatgttcctgacctccctcaggatgtcagtaggcgtgacgatacccacgagcctgcctccctctatgacggggagcctgtggatcctcttgtcggagaggatcctggccgcctcggccagggtggcatcgggaccgatggtgatgcagtccttcttcatgatcagggacagctggtcctcgtccagcttcctgaatatgtcccttctggagactatgcccatgagctttccgtccgaggagcgtacgaccgggagtccggtgaggttgttcctgaccatggtgttgatggcgtcgttacggctgcccggtacttccaccacgatgggggccgcggtcatcacgtctgctactgtcttcatttcgatatcactccgagttcctgactacgataacggggcattccgaaagctttacgaccttctcagccacgcttcccacaaggatcttcttcatcccggtccttccgagggtgcccatgacgatgacgtcgtactttccggactcccctgcgatgacctcggcgggcactccggagaggaccgcctcttcgacggggatgttcctggcctttccctgttcggacacgtatccgacggcggccttcgccgattcgtcggtagcatacttgtcctttacatacagggcggtcacgcgccctccggcaacctcggcaaggtcgaaagccttggcgacggccgccttggtgaattcgctgccgtccgtcggcacgagaatgttctggaagctcatttcgttaccttctgcttgttcttgtttattgtttcatattatatctatgattgccagggccccgtcattgcttcgacggggaggacctcacaaccatcacagggcacttggatccctcgatgaccttctcggccacgcttcccatgaggaccttgctcatcccggtccttccgagggtacccattacgatgatgtcgtaatccttggagacagcgtttatcgctcccgaagggatgccttccacgatcttctcctcgaacccgacgccggccgccgtcgccttctccttgacataggcgaccgcctcgcgcccctccttctcgagggtctcgtagacgttgacgatggccgcatccatgggcatgttcgaatataccgactggtcgaccacatagagcgccgttacggtgcctccgctgaccttggccagttccatggccttgtctacggccgggttggtgaaaacgctcccgtcggtggggagcagaatcttttcgaaactcattttttggactctccgcatcacggaacgaataccggtccctcggagtccagggccgtgtcgggggacttccccgggcatggcaggacgaccgctgggtcggaggttccgaatgctgaggatatcgatttagtgcgatttaataactttccaccgccgtctatcaggcaatgccagacatcggatgggtctccgccctgtgcggagagtatcccggccagcatcctcgcctccccccgcatgtcgggagggcacagcatggcgttgtccgtcccgagggccacttccgcccccagttccagcatccgggccgccctcgccgtcttcccgaagaagcggttcgagcggggacatatgactatggggatcccggcgtcggcgcatgccaggatgtcggcgtccgtcgcctccaccatgtggacgacgaaggccggttccagggacatcacgaactccatgtcctcgcggatcctttcggagacgtgaagggcgaacggtttccctgcggcatgacaggcctgggcgactttctccgtatatctcctgtccatatcggagacggatggcagagcgatgccgtccgccacggacaggatgtcttccacttccccaccgtcgaacgacggggataccggacggccgaggacgaccgcatccgacagggccttcccggcgagtatgcatcccttcataccgccctcgcggaagtccacgatcgtcccgatcccgttggagcgggccgtctcttcgaattcatgcatatcgtggaccagggtgtcttcggatacttccctcagatacctgtgcttgagtccgtcgggaggggctacgagctcctccaaggtcattccgggttctaccttcacgcctgcgtcggcgcagtgggtgtgtccgtcgaccattctggggatcacgacacctacggcgtcagggacgtatggtgccttaccctcccctatctcgacggtcttcccgccttccacgagggcatatccgtcacggaatccttctccgtcgtagaccttgccggccagacatttcatgctccgggggacggtgtccggcgtataaaaacggcccgaaggtacgggcggacctgatgtttccagatttcgggggcatatgtccgccgtactcttacgcagaccgtaaagcttatatttgaattagccaagcctaatttaggataatagaaacacacctaatccctaaatactacattacgaatttttaatctaaggtgaattaaatgccgaagattgttgctgacaactgtgtcgcttgtggcgcttgcgtcgacgtatgccctgagggagccattaccgtcggagatgtcgccgttatcgacgatgccaaatgtgttgactgcggagcatgcatttccgagtgcccctccgaggcaatcgagaactgatcccgagtctaaaggtgaatcaaatgccgaaggtaatcgctgacaactgtgtagcttgcggagcatgcgtggacgcctgccccaacggagccatcaccgtcgacgacatcgccgtcatcgatgcatccaagtgcaccgactgcggagcatgcatcgacgcctgcccctccgaagctatcgagaactgatttccgataaaaccatcatgcggatgcatccctctttttcggatgcgtccgcttcacacgttttcttttaagaacgaaggtcgtgcataggccgaccacatctgccatatacgacgcttatgaaaatctggtaacgggtcggacggggaaaaagccccgttcaggcccagtagggtttcttgacgaatttgtatgccatgaggcatgcggtggcggcttcgccgcatcccgtgatgatctgtttgtacttgccgggatagtcgacgacgtccccgcaggcgaagaccccgtggcggttcgtactcatgtctatgccgaccttgatgagaccgttctcggtaagttccagaccccatttcttcaggatctcgaggttggctgtgatcccgatatttatgactgcgaggtcggcctcgatggtcatctcttttccatcctgttcgatagtgatgctctcgaggtggtcggtaccgttgaacgacttgacgtttgcgttcattatcttgcggatattgctttcgttcaggttcttgacgttcatctcgtcggctctgaactcgggtctgcggtgtacgatggtggtgtcggtgacctggtcggcgataagggccatctctatggcggagttgcctcctccgaacatgaccaccttctttcctacgaggtcctccttgacggggaggatgtagtcgattcctttgccctcgagttcattctctccgggtgcgccgagcttcctgggggtgaactcccccattcctatggcgacgatgacggacatcccttcgtattcgctgtcctgggtcttcacgatgatcttctggtctccgtcgacgatgtcgacgaccttctggttctccctgatgtcgcactccatgctctcggcctgtgcatatagcttatcggagagctttctggcctggacggtctcgaatccaggatagttgtgtattcctttctccgggtagagagcgacaagctgtccgccgacggtaccggactcgagcacgagggtgctcatcatcttggatcttgcatagatcccggcggtaagtcctgcgggcccagccccaattacaatcacatcgtagaccattgcccgaccccatcgagtaaccgtataaaaaaatttagcccgttagaaacgtaatctacagtgttttgtctgttgcgctatgttttacgtcggctgttctgcggatttcgtattattgttgtttggtttgcgagaggtcgcatggaaatgtgcggaagcattggaaggcgatgtccgatgacgggtgtttttcgtatacgcgataatttactggaatgttccagatggaggattatacactcaattaacctgttataccattgatgaaaataatttttatctggcacttattgatgtatgtatgccatacggggtctataatcaatactggatcattatattggacatgacagtgttgtattgggtttatcggaggtttccggggatgggctaatgcctatataggttgaaacgattcacaccgaccatggatatcgtctacggatcgttcgcagcgtgccttgtatgtgtcgtagtgtatgcagtggcattgctcatcgtcgatcacaagaaaaagaacgacgaatgaagtaaactctttcggggtatccacccttttttgtgtgtttcaaactcatcggtctcgggccctacggcatggtttttcccattttcatgtgccagaggcattagttgtaagataactccaacaaatgtcggttttttacgataatttttaatattgacaaggttaagcagtgagttatagattaggggatatctgtcggtcgattccaggcagttccgattagggggaggacttacggcatcgcacggaccttacgctcatggacttactatgtccaataggaaggcagcattagccgtggctatggtcgcgatcctgatagccagttccgcaggggtgatgttcctcggaggtgctgggtcttcggatacgggcggtgcatcgtcttccaatatccagacagtcacatattattatgacagcagcgggtcggagtcgtattccgtggagtacagcgggatcgcatcgtccgagtacaatccggaatattgggccgggacatttgctgatttgaacgggaagaacgtagaaaactgggtcggttccgaattcaattccagcagttttggttatacgctttgggccaacggcatcgacatcaagaacagagtatccaatgttgtaatcaacttggacagcaggtgtgattataccatcaactgtaaggatattagattcttgtacgattatggaaattcatcttgggcgggcaaagtcggttccgtcgtctttaagagtggtgacagttcgacaaccgtcacctattccaacgggtcacccagcgtttcgagtgtcagtctctcgggggttggcgacaaatccataaccattgttcccaaaagtactgtaaaatcttatatgctggatctctacgttccgatgacgataagctgttccagtccgctgaacaaggtcttcggaggatggacggacggaacaacatcataccttccgggggacatactgccttccgatgtggggtcgctttatgccatctggatcacacccgacgtattctttacgacaagtgttggcgatggcagcaatcttagcctatccggcaattccgggaccttgtctgcggatatttccaccgaactaacattgaagaaagacagttatggatatctggtcccgttctcttcaagtaattattcaaatgtcaaggtcgagttcggagacggtcgttcatcgtcctccatgtacggatcgatctacgctctttcttccggttccacatattatgctgacagcgtcaatcttcctgccggaacataccgttcggcggacctggatagacccgccactctgagtactggcagcggcatatgtgccctaagtggggatgcggtgatcgacaatgtctatctgtccgcgagttccggcgggaccacccacggagacggttccgccggaatagtggccaacggacatatcctgatcatgggagcagggataacctccaatggaaacaaagagaatatcgatagtaacaatcctctcggtccgcagatcatcggcggttcgacgttcggaacgctctatggtaccgccatcaaggatatcgtgttcggtgcgaccgatctcgagggcaacggaaagtccctgaccgtgaacattgccacgtgcgttataatccacagcgggatctactataacgtcgttgccggaagcgtcggtcagaatatagggaccagctactctcccgcctccacatatctggtgatgaagggcggtaccgtcctcgatacccttatcggaggtaacggaagcagcggggtggtctacggttcatccagtttgaattccgaaagcgagaaggaattacaaggcgggaccttcgtctatatgctcggtgccgatcttcccggggacgattacgaggactataccaccgggtacgatcaataccgtgatgaccggggcaaatatcttctcaaagagtcatccattttggaaggagggtcgtccaacaccaatgtatggggatccacccacgtattcctcagcgatgacaccacggtcttcgatgtccaggccggtggcaggagaggggggaccgagtgttccttcacatatctggagataacagggagcgccgtggtcaggcacatcgcatgcggtaccatcaccgacggtaacagcggtagtacgaacaatgcccatggcgtaagggtcgtagtcgacggcgatgcgaaggtcgccaccctttgcggaggagggtatgacacttggtccgctccggagagtcccagtaccaccgagggaaccatcgatgtggaggtttacggtggtattgtgggttatgtatacgggggtggtttccgcggttccttggggaccacgtacaccagcgtgtatgtcaacgtgtatgtggtcggcggaaagatcctgaatgacgtatacggcggcgggaggggaggaatagagaagatcctccattatagcactggtacgaagtccgcttcaggaccgggattcaacgattctaccgggaagtcctacatctacggcgatgtaaatgtccagataggtcacgatccggagaaattcgtcggaaggaccgccgtggtatacgggaatgtgtacgggggaggggaatccgtcccgctcatgaagagttatgtcgtaggggggaccgcatacagtttcggtacacagaattcagaggtcgctgccgtatacgggaccacttccgtgagcgtgctcccgggtgccgatatcggcggaagcgtatacggttctggaagagggatatcctacgactccgccgggaacatatcggccgaagacaacgtcgagtattccaccatgtatctcatctcctattccggttcttcgttctcccccaagaatgtggcatggatgtcgagcaattccatcccaggtacggccacatactattccaacagtgaaatgggttcgatattcaccgatttcgccatggtgagaggtccgtcttccgattccgatcccgtatcctccgtcaccgtctccggaggatccataaaaggcgacgtctgcgggggaagcgcatacggtataaccacccagaatacgatagggagcaatgtcatatgttccgtggagatctccgcaggagaggtcggagggtccgtctatggcggaggggtaggtgtagccggcaagacctcggtatacggcagcacgagtgtcagcatgaccggcggggcggtcaggggttccgtgttcggcggcgcatattacggagtcatagaatacgatgccgaagtgatcatgaccggcggacaggtctatggttccatctatggaggaggatatggttccaacggaaaagtggccgtgaacgggacaaggaaggtcaatctcaaggatgtgaacatcggggagaacatctacgggggttccgccctcggtgacgacgggtccgcaagcaccaataaatcggattcatacataatcatagactcaggggtatccatagatggttcaatctatgggggtggtttccagggacacacacatggttgcacgcacgtatacataggatacaggaccgattctaccaacgacgtgtcgtccgccacacccatatccgacggtaacggcgaggtcatcaggatatccggctcggtctatgcgggaggggatgtgggaacgctttccgacgattcgaccgcatacaccagcagccttgttcacaacggaggtaacgtgtggatcaatggggagtccctcagcctatccatttcaggcagcataagccagcggcaactcgtgtctgaccgaagggagcaccagcatagttattgcgcatttcaacaatccgtctcccatggaaggtatccatcgtgccgataccgtcctcatatccgattcgtccctgattcttaacggaagagggaccatagacagtttcaatgaatccaaactctattccatatatgggatcgagaagttggagctccagaacggcagcacgataacgttatattctgccgtggacaacgtcgacagctatctcagcctcaataaggacgggagtgccacgacggcatcttctccgctcaacatgatcgtgttcggtgccggaaataccttgttgatcagagacaccgacaacggttccgtcacatatgggcgggtggaaggatattccataatctccgtcattacatccgaggtcttgtacggagggtacgcgctgggtgctttggactccacgggcggtttcgtccttatgcacggagggtcctataaggaggccgacaagaccgattacgatgcatgtcgttgctggttcatctcaggtacgatgagtctcagtactgcgatgacgctcatgtactcgggaagcggatcctccatcagcgcatcttgcagtacgcagttcgatatgacgaaactcctcgggactaccagcatgaggtacaccggaggggtctacatcgagtccagtgcgaacacctattcgttcatagggaaagatgggacggcaggcgtcaatcagttcaagttgctcataggttccaacggaggcgtcgccgccgacaagatgcttctggataacggtagcggcgtgtatttctccacagacgataccaacacatacatcgcgacagggaacggcgaaggcggagcactcaacaggacgtccaaactgtatgtcgaattctccggtaccgtagagaacaagacccagtatgtgggatatgtgcttctgtacttccaggaggtctccgagatacaatacgaggtctcggcggatacgaccgagacttcgtacatcataaccaactataccgagatcaggatcgacttgtacacccagggttctggagacgtgaacaacgtggaggtcacgatcggtgcggcccgtggttccggaagcacggatgtccagatccctgccaagtcgtcgtattcgggggccaccgtcagtgtcgtcagcatgacgtccacgaccggaggggatgacagcatatccgtagcctcgtccaagaatctggacaataccaacgggtgggtcatgataaccccgggttcggcattctccccgggatattcgggatccacccagataggtgtcctgcagggagggttcatagcggacatgaagctctccatcgagggtttcgattcgtcgagtacacagacgtacgtattgggtatcgttctgaagacccaggatgatacagagtatggattcacaataacagtgcacgtgtccgtcctcgaagacgtcaaggtgacgttcgtcgacgatcagcagggttacacgatccaatatatgttcgaatacggacacaggatgacgtcttcggaatgtcctcccacccgtgataatttcatcggctggtatatcgacgacaagttcaacaacgcctataatttcaagacccctctgacaaaggatctgacactgtatgccagatacaccctcacggtcatattcgacaactgtgacggtaccagttccgtcctctatgtggcggagcaggatggagggacgtccataaccgcccctacggacccggtccgtgaagggtatgtgttcagcggatggtacaaggacagcgactatgcggtctcctggaacttctccaaggacagagtgacggagagtatgaccctttatgcgaagtgggtgggtgtggagatcgccgtcacattccagtatgtggatgacgggggcaagacccagacggtaaaggtcggagaagaggaatacagtttcatcgtcaactacggaaacgcgttcggtgttctggacagcgaatacagtctggagcagaagagggacatatcctatctcgagcgtgcgaggagcatagtggatgcctccataacggagaagttcatccgctggtccgttaccgtgaacggtcattcccttgcagtatacgacgacactatcgcattgtattataccgagggtcccgacggaaagtgttccgtggtcttgaacgccgtcgtctccccggtcgccgtccaggtcgtcatggataccaactgttcggacctcacaggggaggtggatcccccgtcgacattcctggtctatccggaagtatctgcgactgagaatccttcctactatgtgttcaaatacgatctgaacggtgccacacgtacgggatggagccttttgggttgggcgctttccaaagactcttccgactattccagttccggaacctccatcgaacttcacgtctatttcacaaagagcggcgattcgataatcgtcagcgacataaagtaccccgatggatccagtacaggtctcgagaccggtattgcaatcaacgacgagaacaacccctacaccataacgtattacgctctatggagtcagatcgactattccgtatccgtcctcacttccgcccacggtacgatcgatgcgtactacggcggagtgaacgggacatcattcaccgcccactacggcgacaccataaccctcaggttcaccgccgacgacggatacgagttctacggctggttcgtgaacggggagggggagatcgagaacgcaggtgtctcttctaccacactcgtggtcaccgggaactgctcggtatatgcggtggccaccggtccgcagctggtgaggctgtacgtctacttcgacgggggttcgatgatctcctccgtgccgtccgccgttttcaagggtatgggcggagtatcggatgcggaattgaccttcgaaggttggtactccgattccgagagcaacgggttctatgcccagtatttcggaatgatatccaagggcacatacgaggtggggctcagaggctcttccgggaccttctatggattcaagacgttggacgtcgatgattccgtccattccacgtctttactggtctatacggtcaccaatgaggtcaaggtcgggacaagtgatgagaccgcctccagcgggaccggacttgagggatattccgaattcgtggcggccggttccaatgtggatatcgccctgtccgccggatatctgttcgacataacgctcttgtatgatgcggccgtcgaaaggaactccgggaccacaacttcccagcaggtcctgtccttcagcatatcgtccggaatatcgggcggtataacgatatccggtactctgaaggtggccgacaggaatgtggtcgtacacatgttcctgatggatatcggagggggatcatggagttatagctcctccgagaccatcataatggaggttgctgcggagtcatatactggcacatattccatcccatccaattccggattcatattggatgcctccaagagcagttcggagtccggtataaccaatttccaggtcgacggtaacatcctgacgtttaccttggattccggcgaaaccatcgaactgtattatgagaggctgaaggccaacgccgtcatcgtggtggatcccgacgcctccgtatcggccatggacgggtggatccaaggtacctccgaggaaggcgacatcacctacaccaagaccgtctacttcggagagaccgtggtccttcccgaagtatccagggaaggatatactctgaacgggtggactctgtccgggtgctccggtactctgtcctcaggatatacctatacggtcaccgccggcgacgtctctgcagaaccccttaacaccctgacgttcaaagcggatctttccgacaccatccacaccctcacactgataacccagtacggtacattcagcaacgggtcgtccaggatgtccgtcaaggtcaagacgggcgagtccctgcagacatatctggaaacacccgttctttcggaggatgacaagggaagatacaccttcgcaggctggtcggatctggatgtgacgatgccggatcacgatgtatcgtatacggcggtgtggaacgctgtcacatatgttcttaacttctctgcaaaggaaggggatacgcatgtgagcatcagcgctacgaacaattcgctcgctgccaattccggcgaccgcatcaattacggcaactacgtcacaataaccatcgtcttctccgacggttattccatggggtcgtattccccgaccggttccgagataggttcccctgtacaggggagtgaccgtcagcactactcctgggtcttctatatgaccgacgatgtggacatcgtcatatcctccgccgtctccactttcagggtgttcttcgtggtgaacggggtcttggaaccctccctcacccaggactgtgtgaagtatgcggactgttatttcgacaagttcgataagccaggatacagcgaatccctctggtatacggattctgcatgcactaacgaggccactacgagcggtggttccgagcagggctattattgtgtcaagatcgtctcggatgtaacgttctacaccaatgccgtgcccaacacatattccgtcgtgttcaatccgaacggaggcacaggttacatggatgcccaggagttcacatacggggttgcacaggccctcagtcccaacttgttcgagtgggaggggcacaggttcgtcggatgggccgtctctggagacggggccatgcgtttcgtaccgaatgcgatcgtttccaatcttactgcggaggataaggggatgtacggcctctatgcgatatggatcgtcgagaacaatgtggcggatacgaaatatgatgggaacagctacagtgccagcgtatcgatggagaacgggaaccccactcctttgaccgtttactacggcactgtcggtctgacatcgagtaactatctgacatcgggaaccaccgatctgctggcatattgcgacgtcttaagggacggtgacagcatagcctcgtacaaggtatactattatgcgatagccggtatcggcgatttgtcatccgtcgtcgcaggttccctcactgtgaccatcagtcccagagaggtgaccataacctccggaagttccaccagggcgtatatggaagatgagaataacgtagggatacctttgacggaccatactgcgacgtattccggggacggtttcgtcaccggtcagggagtggtcctgacattcaccggttcgcagacggccgtcggtcagagttccaatgtattcacatactcgttcacgtccgtcaccaaatccggcaactacaacgtgaccgtagtgtatgggactctggaagtgttcgaagccactaccgacataatcgtcgacaagcagttcgataggatatatggcggtgaggaattcgatatcggagcatcgtccacacacgggatggtgcagtatgcgacggacagtacgtccgtcatctccgtggacccactgtccggcaaggtcaccatattgggtgcggggaccgccaccgtgaccgtttcggtgccggcatccgagggatactccggtgcgagcgtcgatgtcctggtcataatatcccagaagaaattggaagtctccggattgtcctataccaaagacaaggcatatgatgggacgaccggcgtggagttcgatacgagcggtgtttccctgtccggtatcgtaggcggtgacgacgtctccgtaagcgtctcgatgtactattcgtcgaagaatgccggaccggtgcagatcgagacgatatacaccctagaaggagggaaggcgtccaattattatgtggataatcccgatccggtcgatgctaccataagcaagagggcgatcacgatatcgtccggcagcgataccaagatgtacgacaagacgcccctggccgtcaattcgtacaccttatcgcaggaattcgtctccggagaaggtcttgccgaggtggtctgtacaggttcgcagaccgtcgtgggaagcagcagcaatgtgttcacatacaggctgacatcgacaacctctgcggacaactatgagatcacggaggtcttcgggatattgaccgtcaccgtacgttacatagacgtccctacggccactcagagttacaagtacaccggaaaagacgtttctgcggcagcggtcatacccacatccgaatactatagcatagatgggttcggtcgtgaagtcggaacctataatgcgacggtctccctcaaagacactgtaaacaccgtgtggaacacgtctccggccagctcgtcacctcagtccgtgatatggtatatcgtcatgtcggatctggtatggagcaacttcgtgatagaaggtctgaacgatgccgtggaatattccgcatcggagatcaccaaagtgatcaccagcgacgtctatacggaaggagtggattatgccgtgtcgtattccgataacatctacgtcggtacggccacccttacaataacgggtgtgggcggatacggagggactcagaagtacaccttcaagatcatagagcgccccatctccatcagtttcgagaatttcggatatgtgtatgacggaacgacccagagtcttcgttacaccttctccggcatactggggtccgacggggatggtgtctccctggtgtttacaagcggaggcagtgccacagatgccgggacctatactgcggtggtgtcgggtctgaccggggatatggcatcgaactacaggatcaacagtgattcgaccgtatccgccgattggaccatctccaagcgtgtcgcatacataatcgcaggcagtgcatacaagaattacgatggtacggaattgacctgcagcgattggtattccctggggttcaagggtaacgatctgaacaagatctccgtggatatcgccggatcccagacggatagggggtcgtccgtcaattacgttacgtacactccttccggaaacatcggtaagaactacgatatccatctgataaacggtactcttgcggtcttcgaccctgtcacctcgtccgtctccataggtgttgagactccgtctacctcatccgagaatgcctctctcgtctccggcatattcgtggaggatatgttcgatacctccacatggaggtctctcgtaggagaagcggccgcatccatgttgctcgcatccctcctgatagtatgtgtcattcgccgcagggcgtattgacatcgaatgccttcgtctacacccttattccggccagggccatctttaaataccttgctatcattgttatagttaggtgaaccaaatggtagcaatccccaaaaatgtaatggacctgcttgccgcacccgatgcggttaaagttattgcgaccgtctccgctgacggacagccccatgtcatcgcagccgggaccatcggcgctgtagatcccaacaccatgatgatcggtaaagtccttaccaaggtgtcctccgataacatcaaatctggaaagaaagtcgccttccttgttaccaaaggtctcgagtcctactccatcaacgccgtcctcaaagacatccagtcctccggacccgtgtacgatgcggtcaaccagaaactcgctggaatgcacctccacgcatccgagcttatgttcttcgatgtcaccgccgttttcaaccagggtgcaaaccccgaagccggtaagcagatcgcttgagaaaccatatcccgggccctcatttccgagggccacccatttctataaaatatactgatgccgatactgtagcgatggcaaaattaacacccgttctggtagacctcatcaggcgccctgatactaacaaagtcatgtccacgatatcggaggacgggatgccccatactatagtgtgcggtactctgaccgtacccgaggaggacgtaatagcggtcggccgtgtatggctcaataggaccggaaggaacatccagagggatccgcgtgcggagttcttcgtatggtccgggaaatatgcgtactctatcctctgcgagttcatagggaattccgccgatgagaaggaggtcgagaagatgaacgaagggctcgacaagataggtctcggtaccagcaccgtgtggaagttcagagtcctcgccgtatacgacgaaggcataagcgatacgatgggcgaaaggatctcctgacggcccattttaacagaggccttcccccggcctctgctctcgttttaacgatggcggcttccatcatctggcacatgtgagacgggcctgcagtactatttgtatataaattacactatactaagccttcgcagacctctaaaacacgtcgataattcgtttcgaagacaccgtcggtccgaccgtggggaggcatgtgccggggatctccccggaatccgcacgttcgacccgggatgatcgtgtgaaacgacccattttcagagttcgaatggatcaaaagtatagttgtttactttgggaaatcgttataagatggttcttcgactcgtcgtgattatctcgacatggtccgtttgtcattcataacaaaacggtccggtatcatttttgataccgccatatcgaaatgtaacttctctctcacgagagacttaaaatcaatgtcccacagaatgtaggttttccagcctcggacgtctgtgggaccgtcctcggccgatgatcccttactcagaatctccttccgcgctgcctgtcttcaggctggtgtttcctgaagcagtccctgcagtagacggggcgtccctcggtaggcttgaagggaacctcgcactcttttccgcagtcggagcagacagttttgaacatttccctgggttcattcctgtccctgtaactccttccgccgttcctgttgttgtcgtaggccattattattcctctattgggtattctcgtacgtccttcctaacctatcttacaacgggtgcggaactaactatatccgaatgccttactagtgctaatcctgctgttgattaaataccttgtccctcgacttgattagatgtattcatcccgtccctttttaataatagggaatcatacttttggatgatggataggaacaggtcaggtgcccgcgatatcgccgctaggatccccgttatcggttgggaccgtcagacgaagcaggacaaactcgacgcattcatcctgaaggtcttccccggcttcgtagtggtcttcggcgtcatcgccatattggtcttccttttctattgggacggtcttacggtaggtcatctcctgtattccctcggggccgtctacgccgggggtttcgttcttctgggtatacctgcgttcatactttcggagagcgatgtggtgaaggcccgttattcggtacccttcatcatcgttgcctggcttgcaatatcgtcggtactttggttcgtgttcggggacggggaggataccgtcaaccattttgtgtctgggttttctaacttcctcaactggagcgtccactccgtcacgttctggaccgtcctcctgggaatgctcgtacttatcctgatagtcttgttcgcctcatacggtatcctgtcggtgatcgtcgcatatttccgcaaggattatcaccgcatcatgctctcgctcatcaagcccggggattcgagactcaagagatcggccaccaaacttttcgcagtcccctccataatcgacgtgaccgatgtcaccatagagccggaatcggacgatggccatttcaatatcggtcttttcaagagtctctcatgtaataccgtggtcgcagggctgatcgtagcttcataccttttcctcaaccccgtgttcctcgatacgatcagtttcacggagatgatggtcaccctcatcctcatatcgttgttcctcaacgtcctcatcataccgatcagtatactcaaatccctgaaagccgaggcatggtctgccgctcctcgtcccttcgtcctgtggaaggggatgaaatcgaggatgttccaggggtacgtattcgtcttcctgatgctcacactcctgtggatatgcctttattccggacaggacatggtcagggtcgtcctctcctacatcgggtatatcgtgttcatcatcatgatgtccgctttgacctccttcgtgtatgtcaacaccttctatgtcggtttcaagaacggcatcgtcagaaacttcaccgccgaatacggggagaggaagaagagaaattgacggatgccctccgtcacaggtcgagttccattttttatatcgtcaatccataccgagcccccatgagcgacccggctttcgaagcgataaaaaaggcgaggaatcaggaccagggagggaacccggagggtgccgccaagaccctggaggattatctggccacggatccgtacaacgtccctccgaggatggaactggcacgtatctacaattactcgctcaagaaccgcaagatggccctcatacagctcgatatgatcctggacctcgatccggataatgtcgatgccctcaaagcctccaccaccatcaagatgttggacaaggccaagacggaggaggccgatgccgagttcaagcgtctcatagccctcgtctccgagtccaaggaccctaaggatttcgcagccgtctgtgccgtgtacgccgtgttccagaggaagcagaaggtggatttcgagaaggccgccgagtactacgagaaggccatcgccgcctgtcccgacatgtacgaatatcatcaggactacgccgtcctcctcttgaacgacataaaggattatgtgaaggccaagcacgaactcgaagaggtcatgagactcaggcccaacagcgataccgcgaagaagaactatgacatcctgatgaagaagaagttcgacaagaacgggaatctcaagaggtctcttcgcgatcgtctacggcatcactgacgtggcggtcgaggaagcggagcatcgccgagatcgatcttacactttccggaagggcagggttcttgctgacgaaacctcttgtaaggctctctttctcctcgaacaccatcacgtcgttctccaccttgttggtatccaggagccgatgcaatttcatcacatctggtttcgccctgtcggaatccgatgttatctgatacacgcggggcaggaatctgagttcatggttgctttcaaggaccaacgagtccgccagctccttgttcgtcctgccgatcttctcgatggcgtctctcacgatcatcatccttgccgcattcctgttagtatccgtcatcccgcttatcagaccgatgccttttatcgtcgtccaaggggccttgatccccatggcgttgtttatgcggcgggagttgcataggagggagaaccacgtggccatgagcgccccgtaggatgtccccatggcataacagcggtcgaggtcgaagccgaaacgtcccctgttgaagttcatccagttgagcatggccaggacgtccttcagttcatccacgatgcctatgtcgccggatatgtcgcggaaatccgcgtttatgacggcgaatccacgctgtgccagagcctgacatatgctgtccgatgaggaacggtttccgtggaagaacgaccccccgttgaagaacacaatggttggcatcggtttcatcgattccacagaccagaacacatctatgaagtgtcctttctgacggtcttccagatagggtatgttggattccgaacggaccgacggcaggtctttcatgaccttcttgggtggtctattcaccatacccgcatagatgcgggctatctcggcagtgatgtcgaacatctttcggacggtccagtccattctgcgatataaaaaggattggtcggatcggtactgtctgcatattatgtaatcaattacagtaatgtatggaaatgtgcgttaatataggctttccggggcgcctttacaggttaatgatgcagtcggtgccgtgcaaaatatgtagcgagttcgtaaaatcttgtagtgtggcgcaggtcttttaaatggggataagatactcgaatccgaggattactatggaactaaaaggatccaagaccgaagccaaccttctcaccgctttcgccggtgagtgccaggcgagaaccaagtacacctactacgcatcccaggccaagaaggagggatacgagcagatcgccgacatattcatggagaccgccgagaacgagaaggagcacgcaaagctctggttcaaggcccttcacgacggtgcggttcccgacacggtcgccaacctcaaggatgccgccggaggagagaactacgagcacaactccatgtacaaggatttcgaggaggtcgccaggaaagaaggattcgaccagatcgccaaccttttcaagatggtcggagccatcgaggcccaccacgaggagaggtaccttgcactcctgaagaacatccaggagggagcagttttcgagaaggaccaggtcgtcgtatggaagtgcaggaactgcggacacctccacgtcggaaaggaggcacccaaggtctgccccgtgtgcaagcacccgcagtccttcttcgaagtccaggcacagaactggtgaatcaaaatccaggaccttcgggtccgaaaaccccctgttccgtttttttcggaacaggaggaatcccggggtttgatccccaggtgttttacatcgcatcaagacttgaatgcggacttgtactgcgtaaggcggtaggtgacgaatatccccacaagaagggtgatgatcccgatgaacgcggctatcgtcgctacggtgcacgtaatgaccgcgatcttgtatttctcccctctgaaagtgaagtgtcctgccataagggcgcagactccggaaaccgttatgcatgctccttcggcgtatgtgatggtcttcagagtctcttcggtgtatccgagggccagatagtcttcccacaagtccatgtccttcagcatgttgactgcgttttccacggaggtctcggcggagatgatcgtgtagatcccgtatatggtgccgatgatcccccagaacagcatgaggtaggaaagtgtcttcaacccgtcggagttcgccggactgttggtagcacacccgtatccgatcccggtctgaggggaggcggaatacgattccttggtcatgtcgtcgatgttcgctccgcaggcgggacagaaattgtctgtgggagcaagctccctcccgcactcggtgcagtatctgacattgtcatccatatggttcgtattattgacaaggtataaaatttcggtgtaaaacaggataaagggttttgggagagaggtatcaaaggtcctctctcgccataagggccttcttcaatacggccgcctcttcgtcggtgagggtgatgcctttacccatcttgtttccgtcgggggaccattccctgatgtcgtatttggggtccttctcgttccaactgacgaggttgaactcctttgtccatcccttggaagactgggagaggacggcgatcctttccttaatctcataagtgaatgtgtctgccatttgattacctgtttccgtaaattcattccatattataaaaactcccacgtggatggttacgggtaggatgccgtatgcagacgccgtacacatctggggcggagtaaggacatatgcttaaatcgcaggatgtcatgttaatggaccattcaatacgccataaggcctaaaaggaacgtgtaacaggtaaatggattcaacatctacgatcattctgaccgcgcttataatcgccctccttgccttgtcggcttttttctcaggtaccgagactgcttacaccagcgtaagcaagacccgtctgaagaatatggccaacgacgggaacaagaaagcacagcgtgtgctttccaactgcgataatttcgaccgtcttctgaccacggtattggtggggaacaacatagtcaacatcgcctcctccaccttggtcacttccatattgacggagttatacggggcggagatgggggtcatattggccaccatcctcatgatcaccgtccttctcataatcggtgagataaccccgaagacgttggccaagaggcatcccgagaaggtcgccatgcttttcgcatccaccatacacgggataatggtcatcctgtcacccatcacctgggtattcatgaagctgacccatgcggttacaaaggtggccggagacgacggtaccaaggagcccactatgaccgaggaggaactcagcgtgatgatcgacgagatccagcaggaggggaccatcgagaagagcgaaggggagctgataaagtccgccatcgagttcgacgacatccgcgtatccgagatatgcgtgccgagggtcgatgtggccgcggtcagcgtggagacggacgtggagaagatgagggatatgttcatcacatccgaattctccaggatccctgtctacgaagggaccgtagaccacatcatcggagcgatcttcatcaaggatttcttcatgaagtataccagcgggaagcctttcagcatcaccgacatcatcaggccggtgaagttcgtcccggagactgccagtattgcgaccgtcatgaacgacctccagaaggctaagctgcacatggcgatcgtcctcgatgatttcggaggaaccgtgggcatagtcaccatggaggatatcttagaggagctcgtcggcgagatatgggacgagagcgatatcatcaagtatcctataaccaaggaggcagacggcacctacactgtcctgggcgatgccaacatctatgatgtgatggagaagatcgggaggtgtttcgaggatggagattacgattcgttcaccgtcgggggatacatctactacaggcttgagaggatccccaaggtgggcgacgaggtcgtctacgaggatgtcaggatgatcgtgaagtccatccgtaaccgccgtataagggaggttaccttcgccatagatccgaatctgttgcttactgacgggtctgaggggaaagaagagaatcaatgaatgccgtgaaattcttcacggccacttctttttttgcggggttggatgcgacctttccggttatggatatgacgtctccgtgatgggcgacagcatactccccgcataccgctttctgtttgtcgaggcgtgtatagaagacgcagtcgtcgtctatcctgttgtcgacatcgtccaccaactgttccagaaggtcttttcccaggttggagaagaccaagttcatgtccttctgtttggtggccatgcgctgcaggatgagcattctgttgccgtgctcaccttcgctgacctccgtatcgaactcgtcggtccctaccagattggcgaacgtctccctgacgagatcttccttctcggtggcgtatatgaaagtctctatcctgagccagtggaacgtagcctgcatcactccgcctccacgttctccatgaggatcctgctcaggacctctgggtcgttggtggttactgtaaggacgatccttcctttgagcttgacagatacggcgctgtcgattccggggcaggcgaacgtcttgaaccttactttcttgataccccatccgctgtagttcctgaggatgtctatgtcgcctgtcttgacgtcgatcacgtggtcgagggggacggtgaacatcctcaatatgccagcgttcagttttccgtcctctatcactatcctcaccttgaggaagtaacagaacgggatcaccaagataacgatgagggtcattatgtagaactgccacatcgacgttcctatgtccgcaagcgtgcatgcaagtatcgcaacatccgccgctatcagcgtgatggcaaggatcaggaatgtggttctcgggaagatgtcctcgatctcggtgtattctgtcgacatcattatgatgattccgttcattcattaaatggttatcctggtcagtgctggctatgcaaggataaggtttatatgggagatgtttatactacgggttagtttgggcccatagcttagattggctggagcgtccgactgataatcggaaggtcgagagttcaaatctctctgggcccactactaacttgtttgaatgcacaatcccgatttcgatcgggcggttctgtttgtttctgtagccttgtctcagtacttgttgacgtattgaccaagggctttttcgactgatgtgccagacgaccgtttacactgcattcccagcgatcttgaaagcgtcgtattgggcgtatgcagtcattgtgcagagtcatatctgacgaatattgatacagaaatggatctgcatatcgttggacatcctactgtaagaattgaagcgtggttgtgggaatgtcgtaaatcgtctggatctgtaatgcctatccgaggattctggaatgtctcatggcggattccgaatcacggatctgactttgaacgaggatggtgaaagaggagatccgaggccatgtcggagtcgtatattcttttcaatcgcaaagaatacatggtggaagtagtctgtatgtggggatgatttgaaatggcgtcgcccacagagtgaattgaagaagtggtagacagcgtgtctgctttcccgtacacttgcgcaatacagtacgcgacagatacgcgagcgggcttaacttccgggttcgagatgggaccgggtgaaccccgctgctatggccgtctgaccaaaactctagatagagaacaagtatataaagatatctcaattagcagaggccgctttccttcagatcgtctttcgacgggacagtgatgccgtcatcgaactcgaccatgttggagaacatattcttgaggccccattctgcaagacttttgaggatgggcagaaggctgaaacccctctcggagagatagtattccacgcacttcggtttggtggagcggacgttccttacgatgatcccgtccctctccatctccttcagctgaagggtgaatatcctgggggatatcccctcgatctgtgccatgagctgattgtatctcatgggcgcgccgttacggtagagcttgcagattatgacggtcttccacctgccctctatgacggacatggcggcgtctatggcacagtcatacctcggctcgctgatcatgctctgcccatccaagtggacgtattttataatatccactattattgatgatagttggattcctcacttcttctggaaggcaccgttctttttgtggggaacgactttggaacctttgttgttggccaccagggtctttacgtattcctccgcctcttttttggtggtgaacgtcctagtcgccttctcgtttccttccgctttcacctgccagagtttatcctctttgcgctgggtgatgtgccagaccttggtcttcttggccgccgtcttggtctccttgttctctgcaggtttagcttcggtgttgttctctgctgccattttgtcacctctgttcaaggatcttgatcacatgccatccgaactcggtcttcaccggcccgatgacatctcctttcttggctgcgaaggccgcatcctcgaaaggcttgaccatttgcccgcgtttgaaccatccaaggtccccgcccttcttcttggaaggacagcccgagtacttccttgctagatctccgaagttctttccgccgttcacctctgccaagatgtcggcggcctgtttctcggtttttacgagaatatgtgctgcatgcacttctttgaccatattcaattactacggtcggcgatattaataaccattggcgaaggattatgtatttttcgcaaggtaacaaaaaagtaccggaaccctctatccggaggacgagggttccggaattccggtgatatgtccggacggtggcgtcagtcctcgttccaataatcctggactggcactttcttcgcgggctcatcggtcttctccgtctcctcggggaacggtacggccggcgggagttcgcgggggtctttctgcgtcgggcggtcctcccttccgtccgcatagcgtatgaagcggtcggtggccacaggttgggtcttgttcacatagttccagggccagtccttgatctcctctttccttaccacggcgttggcctcgcgtacctccttgtccgtcgccaggaccacgggtccgaaggaacacatcttctgtcctatggggtcgccctccaggagccagatctcgctcttcttgtcgccgttggttatctccacttccgcatcgggtttgatcttgagtctggtctgagggatgtagtccttgcctgcgacggtcgctccgctgtcggttagataaacgttcctgctggcggaagggaccgtaggatccaacgttatcttcacgcctggatctacttcgaacgacacgatcctcacatgatgggatggatccgccgcccacgagtccttgttggggaccacgcccgtcatcccttcataggttccggcgtagacatgtatcacgcagccgtccttccggatacatgggacgttctccgcccatacgttgtttatctcgacccccttgttcttcttctcattggggatgtgcatcattatctgggtcaccctgtggtggttgtccctgtcggcgaacgcgaggggatacatctcgcagtgcccgtacctgctggaggcggtgatccattggacgtccccgtatccgaacctgccctggttcccgagggagtcgaagtggtcgacgtatccttcggtgcatatggtgatggtctcgtaaccccaatgggtgtgcagagggaagcccggtgcgaccttccctccgtacatgcggtatccgtactgcgggcggtagtcatgtcccagcgatcttttcttgatctcttccaggggcggagcctgctgtctgtttccccgggggtagtcgtcgaagtggtgggatgcgaacatgaaagggtcctcagtgtcccagtgaagttccgcagcctgctcccttacgacggggccgccgtcctttatctttccgaagagtcccatggaggggtcatggcattagccatattttggttcttggacggtcttacaatcggcatccttaataagatgagccggattggtcgccttatggcagaggagggtgttcgtctcaacaagttcatcgcagaggcaggtatcgcctccagaagggcggccgaccgtctcatagaggacggtcatgtgaccttgaacgggagacctgccgttctcggcgacaaggtcctcccggaagacacggtctgcgtcgatgggaatcccataaaaagggagaccgggacggcggtcattctggctttcaacaagccccgcgggctggaatgtacatccgaccacgggaacgaggacaacgtcatagatttcatcaattatcccaagaggatcttcaccatagggaggctggacaaggaatccgaaggtcttctccttctgacgaacgacggtgatctcgccaacaagataatgcgttcacgctatggtcatgagaaggagtacgtcgtgtccctggacagggatgtgaccccggaattcataaaaggtatggcctccggagtacctatcgaggaaggtgtagtcaccaggaaatgcaaggtgttcatggaggacccccgtaccatccgcataatcctcaaacagggcctcaacagacagatccgtaagatgtgtgcatatttcggatacggagtcgtcagactcgtccgcgtccgtgtcatgaacatagagctcggtaacctcaagtccggaaggtacagggacatctccaagaaggagcgcgaggagctcatgggcatattggataagagcaccctcgcagagaaggacaactgaccctttctctcatcaatattttcaggagggggcttccgcccccatcctttttattttcagcgggagaccttctccatcaggccctgcgacctctccagatctccggccgacatctggaacttgttctggagcctgtaatcgccatgtacatccatgcaatccacggccgcagtgagtatgccttcgtccgatgctatgaatttgacggtcaccggggtatcgcgggtgacctcctcgggcagttccatctggaattccccgaccatgtatccatcctcgatggcgatcttcttcccatcgtcgttgttgagggccgaatcctcatagatctggaccttgatggtcaactggccgtcttccatggggtagtaggtcttcacagccgtgatcgggaggacctcgttcctgaagattatgttggagatgtactcgttcttatcctcgtcgatggcgcatattccgaaggatttgctgaggacgttgtggacttcgatgactttttcgggtttctcgatctcctcctcttcctttgtctcctccgtcttcgtgaggttgtcttcctccttggtctcgtccttgtgatccggaacaggttcaggcacgggatccggaacgggtacagggacaggagtaggtttgggggcattatggttggacctgcagaggagtgccgcacccttggctacggactggtcggggtcgtagagctccatgtggatccccgggaaggcctccgatatgttctcccttacctggggcatcctggacgaccctccgaccaggatcagggagtcgatgtcggattccgtgaatcctttggagtcgagagtcctcttgatgatgtcgaccgtagcctggataagaggtttggtggccgcatcgaattcgcttctggtgacattgtaggcgatcttcttcccgcccacgctgatggttcccctggaggattcggctgtggacagtcttttcttgagggtctctgaatcgaggactagggtctgcatgatatcgtcgtccgcctcgatgtcctcttcctcgataccgctctgttcggcgatcttcctgactataatcttggtcagggcggcatcccaatcctttccgccgagtaacctctccccgtcggtggccactgccgtgaagatattcccgtcgatctccagtatggtgacgtcgaaggtccctcctccgaggtcgtataccatgaccctcttcttcccgtcctccatgtggccgaacccgaaggatatggccgcggcggtaggttcgtttatgatggtcacgtcctccagtcccgcgacctttccggcgagtttcgtggcctccctttcttcatgaccgaagtatgccggacatgttatcacggcccttttgacatcgcaggcgtggttgtcgttgaagtcgttgatcatcttcttgagaatggccgcagacagggtgacgggcgtgtattccttgccgtcgacggtgatcttgtagtcctctcccatctttctcttgatggcggtgacggtcctgtctgcagggtacatcaccgacatctccttcgcaggggatccgacgattatctccccgttatcgttgaagagtatcacggagggtgtcgtctcctcctgttcgaagttcttgtccaccgtcggctggtcttcgacgtcgtcgacgaacgccaagcacgaatatgtagttcccaggtcgatccctatgtagtagtcctcggtcatttcccatcccatccttctatagtcctgatcagtcctttgtctcttcggaggccgtcttcgcgacccctcccactttcttgaagacgtttaccttctctttcacgaggacacggccgttgtactcgtatccctcggagatcctcttggctatgacgccgttcttggctgcgtcgtccgtggcgacaaccccgacgatcctctggtggagggtgtctatcttgtcgccgtcctttccgtacggccctatggagacgcctgcgtccagcagcatgttctccatgtcgatctcataggccttgaaggattccagcacctccttggccgtgaacttgcttatcttcttctccatctccgtgcacagtttgacgaagtcctccctcatgttgcacatctgcatcatgaggttcagcatcttctggttcgccagttctccctcgcggcggttgagaagtttgctgtaggtgttgaactgctctctggatgtgacgaactcctgacccgctggcacatcgcccgtcacgggcttcggggtctcggctattatgccgatcttcccggacatgtccgacgtcatgaagtatatgtcctccaccttgccgtcgctctcggccgccaacgcagcgttctccgccatgttcttctcgatcgtgtcgaggcgtttcatgacatcggccacggttgccctcttggtcccggtggacgatttcttcctggtcgtcttcttcttggtctccgttccgggcgtcgtttccgcaccttccgtcacggcggtctgctccaagttctcttccgtcattgtctcatgctcccgttcccgctgcaggtgttgaagagccagatgaacggatcctccaccctgaacgggttgatctccttggtcagtacgctcccggaggggttgttgcccaaggcggatacggcgaagtattcgtgtctggagtattgtccgacgtcatttatgaactcctgccctacggtgcggcgtaggtattcctccacctccacgctgatctcgtcgaagcagaccctgtcgaacttccccttttccctctccacatgtatggaggactcggggccgaacaggatgcgttcctcctcgtcgttctcgggggatttcatgaggacgtcggtctttgtcagtacgaccgccagagggatgtctatactgtccttgcgcttcagtttgttgcctgtacggacgatctccgtgatatatgccagacggtccctgatgtcagtgacctcaaacggtttgttgtccatgcggatcctcttgttcacataggggatctgcaggggatccaccaggaggacgatccccgaggccttggatatgaaggacccaagactcaggaccacggtcttgtcgtcggaatccaggtcctttccggacgtgtcgaagaacgccagcgtgtactcctggctcttctctcccgggaatttcatgtagtacaccatcggttccctggagtcacggtcctcgctgtacgacgtggtgggtgccagcttgcgtccttcctcgaacagtctcctgtaataggagtcgttgtaccggatggtcgtcctgtcggtggcgggggtgaaggtagtcccgaactcggtggagaacatcgtcctcagctggtttatgagtacggcgatatagtggctcttccccacgccttccgatcccagcacgacaaatatgttgctgccgttctcctccgcccccgcgggtatagggttgtggcatatcggacacagtctagtgtatgcggcacgtccgcatatgtcgcagcagccgttggcggatccgcggactatgtggttcttggtggtcaccgcatcggaggccttggggtccttgcccaggaacacggagttctctatgtcgacctcctcgctttccttgaactcggatctgaaacgttttccgtccacgctgtccaggaacgtcttggtgcagagcgggttcgtgcatgcataatgtatcttcgcgagattgacgtcgttgaaacagaacgggcacacgtagttgttcctgctcctcaatatacccatatcgtcacacctccctgtagagcggatggatcagcttatagaggctgtattcctctttgttcacgaagaacagcctcatccttttcagatccgcctttcctttgtccattgtgaaccaggtctgtgcccttccatcctgcagtgcgattggatcctgggagtcccagacgacctccccgtcgttcatcctcagagggatgccgacgttggtggcggtcatcgccaaacggggtatggagtcgccttcggcgcattcgaggtccattactattctcgtgaggttcctgtcctccttcaccctctcctcgcggacgctgtacctcacctttgtactggatccggagtagacgtccatggtgaagggtatcgactccgccttggtcccctccacgtcgtagacagccaggagggttacggtcttcttgttggacatacccatctgtatgcgtatcctcccgtccttctcgtagagttccctgctcacggtgatcttctccgaccggggctggtcctccctggcacccgggtcgctgacgacgactatggctgactccgcgccctccggccaggtgacggtgatgtcgcagtcgcccccgtccatcttcttctccacgtccctgaacgggcgcagattggttatcatcacctcccttcctcttatcgcagtgcggcctatccttaccatcgggtacaggaagatcaccgctccgtccggaaggtcgaacttgcatccgttgtcatagacctcgtccggttccacgggggacatccatctttccacgtcctcgaccggtaccgccgtgccgaagatcctcgccttcctgggggatgcgtacagtacgaccttctccgtactgctccatctggcggagtaggacccgtccgtcctgttccacgagacctccatgtcgttcacgggctccgggtatctggacgtctttcctgagaacacggtccctagggaacgctcggtccttccgttgacgtcgtactctgccacgaagagatagtggtaaacggtctcgcctttcaggctcctgtcttccaccgtccccgtgttcccgtggacgatctcgacctcctcttggcccgcatccccttcctccttcctccatatgcggacgcggctgcatcccctgggggtcggataggtgatgcgcaggccgtcctctatggtctcgaccttcacaccctccacttcgctgaggaccatggcgggaccgcattgtgcgaagtcgcgggacaggatgccccatctcttggaatggatcttgtaatagtaatcgacacccgggtcgagggtcttgtcgaggaatacacctccgggtatctctgcgagggggaccgtggactggtcgacctccgggagggtgttcctccccctgtatatgcagaaggatacgcccttcctgtccgatgggaccgcatatctcaggaggacggtgtccttcctcacctggcacactgcatcggccggaccctcgggaggatagtccctgagtctcctaacggcgttggggtggtccgggcacttgtctgcggccctgatgtagaggtccatggtgtcctccccctccgaatctgccgcaagggagcataaggtgtccgcctcttgtaccttctcgcaggcctcggaatacctttcggcgacgtagtccgcctccatgatcctaggaaattggatcctggcactttcgacggtcgtcttcaggtcgtacaggttccttatgcggtagtcgttgtctatcctgcccagggcccttctgtagtcggaggaggccttgccgatcctgaccagcaggtcgttgttctcggtgaattcggggaacctttcctgcatggagccgaatctgtcctcggctccgcctacgtcgccctcggccaggaggtccatgatcgcctgtctttcgcggcgtacctccctgaatccctcctcgaacccgaatccgcattttatgcagctgcggtacgtggacggctgcgtggtcccgcagtgaggacagactatgcgcatggcctttccgcatacggggcagaacacggtgtccttgccgtcggccaccatcgccttgcagctgggacatatggtgaggcgcgtgttcttcgatgagaagttggctatgaaatgccttttgcagcagtacgcctcaagtatggctacggccatctcgttgtctatggcctcgtgggacccgtatatggatatcaggccgtggaggtagttgctggtgaaaggctgtccgtagtcctcctccatgctctcgatggccggttccatggccctcatgcatctgccgtacctgtcgagcatagccagtctgtcgtccgggtacatgacgaccttgagggccctcatcgcctggatgtaggcgtcctggttctctatgttcccggccttcatggcgctgagtcttctctcgacggcgccgaaggcatcgcggacctcctccggtctgcatcccgggtccagtctgttgatgtccatgttcatggagggcagctctatgagggtgttgaggagttccttggaggtgtacagacccacatccgacagtttctcgaatgcggtcatgatgtcgtcgtccaccggtttcggggctggtacgggctgtatcttcgatgccctgagcaccgtggggccgtcgacgtccgcccacttgagcctcttggcgagctcgttctcagcaccgggtatcagatacgaggatccgtcgtggaggactatgacgtccttgttcagcttcgaggccttggattcgagcagggtcctcccgttctcgaactcgtcctccaggaggacgttgctctctatcacggcgtacatgtccgtgaccatggacaggtaggtgttggccctgaacttcctcttgagggagctagaagtcgcctgggcctcctttctccatttctcctccgcttcgtctatgcgtttgatgatctcgcccttgctgtacctgtcctccctatacgggttcagtccgagcagatagcaatagttctctctttcctgggccatgtcctcaagacctcctttccctcaggtcctcggcctccgacgttatggcggtggctatcgtaccgaatgcgttcttcagatcccccagggtggtcagcatggccccgtcttccacggtggcgatctgcctgaggaaggacatctccacattgtcgccgaaaccgacggccactacgccgatgccgttgcgtctgcaggcctcggcctcgtccatggcgttgtccctccgtccccattccccgtcggagaggactaccgcggtgcgtgcccccttcgtttccataagcatgtccatggccgccttcaggggactcctgtcggtacctctccctagcatgttcaccttcaggtcgttgagggagctcatcacggcgcccgtatccaccgtgaggtccttgaacacctgtaccctgtccccgaaccctatcagtccgatgcgggtgtcgcatccggatatcccgtgtatgaagtccctcacgacatccttgacctcggccatgctctccttcatgctgcgggagaggtctatgcagacgacgatgttgctggttatcggcatctcggtcgtgtggttcccgggggctcccgccatccaggatacgtcctcggggaccggttccgtcgagaccgtcacaggcctgccgttctggaacgccctgacgcggacggtcccgtccccgccgtacatgtactctatgtcgataaccgcgccgtccccttcgttgtcgaaaccggtgaccacgttcttctccagcacggtgcagtccagggggatctcgctttcgccctgcagggtgtagacctcgatcctgtcggtcatgttgcccccgtctatcatgaacggcctggtcatggaacaggggactttcgagttggcgggtatgattatcttgttgatgtagcgggtaccgtccccgttcacggacagcgccccgaggctgtgggacgtcacatccgatatctccatgccgtcggcgcccgtccctctttcgtagtagtcggccatcatggcggcccctttggccaccgccaggtccgtatccgtatgggttatcacgtccgtgtccgtgaggaccctgaggtattcggccacctgcggcatcctggtggatcccccgcacaggaggatctcgtctatgtcggagaagtccatccctatgtcctcgaacaggccgtcgatgacgtccttggtggccttgagcaggaatctggtcttcgaatcgaactcgtcgcgggtgatcctgtatcttccgacgttcccgtcgtatctgacggtgacactgacttcccccgccttgctgagaagcttcttgtagtcctcggcggcgaccgccatctcgttcatgacggacacatcctccctcgggtcctctccgaactcgtcggagaacctcttacatgcctcgtccaccaggactgcatcccagtccttgcctccgagcagatggttccccgccgttccgacgacgtctatcttcccgccttccactctgacgacggtgacgtcgaaggtccctcctccgaggtcgtacaccaggacggtcttcccgttggagtgcctgtagccgtagtataccgctgcggcggtgggttcgttcacgatcttcatgacgcctatgccgcatgcctccccggcgcgtatggtcgccttcctctggaggtcgttgaaatatgcagggacggttatcaccgcaccgtctatcttctcgccggtcctcttctccgcatcggatatcagtttcttcaggaggatggcggacaggtcgcaggcgtcgtatgtcctgccgaatgcctcgaaaacgtaatcgggatcccccatcctgcgtttgaacaccgatgcgacagcacccgtgccaccggcctgcatgtccttggcctcgtcgccgattatcgtctcgtcctcgaggaaacatatcactgaaggggtcaggtccttaccgaagacgttcggtatgatctcggcctttgacgatatgccgtcgtatctagcgatcgtcgaataagtcgtaccgaggtctatcccaaccttcatcgtgcatcccgtatgggggtacattccatccctataaaatatatacgaaggggtttacgaaatccgtataatggtgtaaatcggatgggtagtatacggatttcgtagtgtatggggatcagtctccgcagcgctcctccgacatcctgttccgagcgtccccgcggggtatcctcagggcacggacggcgttcaggacggcgatcaccaggacccccacgtccccgaagatggcgatccacatgtccaccgcatccgtgaaggcggtcagtgcgaggatggcgaatttgactgcgagggccaggactatgttctccgcgactatggtctgcgtcctcttcgatatccgtatcgatgatgcgaccttggaggggctgtcgtccaggatgaccacgtccgccgcctccactgcggaatccgaaccgatgcatcccatggctatgccgacgtcggccctggcgagggcgggggagtcgttaatcccatcacctacgaagcaggtcttcccttcggacgaggacattatcctttccagctcggaggtcttgtccctggggagcatctccgccttgtatccgtcgaggcggagtctctccgccacggcctttccgacgggttctgtgtcgccggtgagcatgtacgtcctcacacccatgtccttgagagaggagacggcatcctccgcatcgtccttcagtccgtcggatatcaccagacgtccggcgtacttcccgtccacggcgacgtatacgttagtctcggacctgtcctcttccgattccaagtctataccgcattccttcatcatccggacgtttccgacggtcacaacacggccgtccaccatggcctccacgccctttccggggatcgcggacgagtccgatatgcgggacgggtctatgtcatgacccagacgtccgattatcgatttggatatggggtggtctgagaaggcctccgcacatgctgccagatccaggagctcggtttccgacatcccttccggttctatgcggttgacggagaactccccttttgtcagggtcccggtcttgtcgaatacggccttatctattccggaaagtgcctcgatgaatgtgctccccttcacgagtatgccgtccttggacgccctccctatcccgcagtagtatgacagggggacggataccaccagggcgcaagggcaggagaccacgaggaagatcaggcctttgtagacccagtccttccaaccggaagggtctgcaacggaggggatgacggcgattgccagggcacagagtacaactgcgggtgtgtagaccttggcgaacctggtgatgaacttctccgacctcgatttgcgtgatgccgagtcctctatgagtgcaaggatcttggcggatgccgagtccctgtatgcggtctccgtgcgcaccatcagggtttctgacgtattgatgtatcctgccaggaccttgtcgccgactccgacgtgtctcggtacgggttcgccggtcatggccttcgtgtctacgaatccctcccctgcggtcactatcccgtctatgggtaccatctcgccgggtcccacggctacggtctcgccaacctccacggactccggttggaccgtctgggtctttccgttccttatgacggtcgcatacggggccttcagttcagccagtgccttcacgtgctccctgctgcggtccacggcacggtcttggaagaattcgcctatctggtagaacagcatgaccgccacggattcagtccaatatccgatggcaagggcgcctaacgtggcaaccgtcatgaggaagttctcgtccaggaaccgggcgtgtacgaggttgcgtatggcgttcacgaccacgtcgtatccgacgaccagcagtcctatcaggaagacggcgcggaggaccgtcccgtcgatgttccagtcgagtacatattccaacaggaggccgaatgccaggaatgccactcccgtacatatgcggggtatcagataggtgtccttctccttctcgtcatcgcattcggataccgtatcggtgcgccacatcctgaaatcggactcgacccgatgggcggtctcctccgctgccttctcgatctcgtcgaagcgatccacgttgccgtccgatacctctatgaacatcctcttgtccacgaaggacagggtcacggattctatcccatcgacctctgagatggcctcctcgaccttcctggcacagttggcgcagtctatgtcgatcccatatgtgcgtctcatcacttctcctccttgaggtgcgtgagcgccgtattcaggaggatctcgacatgctcgtcgcacagggaatagtagatgttcttcccgtcgcgacggctttggaccaggtcggcatccttgagggctttcagctggtgggatacggcggacatcgagaggtcgaggctcttgctgatcccgcgtacgcacatctcgctttcatggagtgcccacagtatgcgtatgcgcgtgctgtccccgaatatcttgaagagatcggccatatccatgacggtatcgtcatccaacatgccatcgcgtatcctgccgacgaactcttccgtctcgcattcacagtgttcttcttccatattaatcacttgaacacttgttcaactgttcaattgtattcaaaggcggtatttaatggtttttcaggtgacggtgaacgccatggatacaaggtattatgtcgacattccgtccaggcatgttttctttatctggcacatgtataagtcataccttttctccacactgtcatgttatttccctagtgttgtccggacccctacccagcagataaatacggaatagcggattgacctcctatggatcctcaggaagcggagaccctatgcagaaacgccatcgacctggtcgtagggaacggtgtcgaaaaggatgcatccaaagccgcggatatcttccgttccgtggcagattcaggttatcccgagggtatgttcggccttgcagagctgctgtattcgggcaacggcgtccagaaggacgtccgctccgccatgaggctctacgagaatgcggcttccgccggaaacatacctgcggcattccgtctgggaaacatccttctctccgaaggggacttcagcgatcccgggaaaggaagggaatatgtccagtcgtgctgcgatgctggtttcgagcccgcctacgggtgcatgggggacgtgtgcttctacgggatcggggcgtctcccgaccagaagacggccgccgtatggtacggtcgcgcggcttccgccggggatccggtgtcgatgttcaaattgggatgcatgtacgaatccggtaacggtgtggacgtcgatcccgggaggtcgtcggaaatgttccgcaggtcggccgaagcgggttttccggaggcgcagttcaagatggcatccctcacctacgacggtatcgtcgatggcgggaagaaagcgtctttcgattggtattcccggtgctcggagaggatccccgtggcgaagttcaacatggcgaccatgcttctgtccggtgacggtgtccccccggataaggagggtgctttcaaactctacagggaattggccgattcaggggatgcggattcgatgttccagatcggccggatgtacatagagggggatggtgtccgtcaggaccccgaagaggggttcagacgtataggcgaggccgcgaggatgggcagtgcagaggcaaagcagctcgtggagaacctccgcagaagacagaatacccagatgatccatatcgatggggcggaagaatgattggaaagaccaggcggtcccccgaccggatcactgttcctttctgatggagcagtggcaggtctcttcgtccttgcagcaaccctttccggatccgcagcatttcttggagtgaagggtcctgaaacagccgtagacggcccctgctatgagggccactaccaatgccagaacgactaatgttgcagtgttcatttgaatcggccctatgcatcgggtcttagtttttaagtcttcctaatctaaaaattatattttagggacggttaatccttaagaagggataagttgtttgccggcggggtttccagccccgccgggtatcagtccttcttcacggtgcagttgatcggattcttctcgtggcaacggcaggtcccgcggttggggcatcctgcacaggtgtctcccgtcttgatcatcctgtaggagccgtacatcgcacctatgatgatcagggctaccacgatgagtacaagggcggtggccatgttcattcggcagaacctcctgctttaaccttctccatgttcttcctgatggctcccaccgggtccttggccaccaggaagtagccgtagacgcaacagaccgccactgcgatcacgaatcctatcgggtcgaacatcccgtgcactatgcgccagagctggtagaacaccagggatgcgcaccatgcgagtatgcactggtagaggacggcgaaaccggtggccttccaggtcccgagctccctgcgcatcgcacctatggcggcgaagcacggggcgcacaggaggttgaagatcaggaacgccatggcctctccggacgtgcagaacgccgcaaggcctgccgcggtgagcagaccctcttcgtccgtggccattccgctgggatccacgaggatcgccagggttccgaggaggttctccttggccagcagtccggtgatcgaagatacggtgagttcccagtggttgccgaatccctgcagggcgaacaggttggttatggcccctcctatgtcggcgagcatggatccgtccgtctcgttgcttccgatgaatccgagtccccagtcgtaggagcacaggaaccatacgatgacgcaggacaggaggatgaaggtacctgccttcttcacgaaggaccaggatttctctccggtgttggtcaggacgttgcggcaggtgggggcgtggtagacgggaagctccatgacgaagggggatggctttccggtcactccgctgaacttcttcaggatgatgccggacatgaggatcatgcagatcccgagtacgtacatcgagagggccactatggccgattcgtggaagaatgcggcgatgatgatcgttatgatggggagtttcgcgctgcacgggacgaacgtggtcgtcatggcggttatgcgtctggtctgttcgtcctctatggtcctggaacccatgatggccgggactccgcatcccataccgatgactacgggtatcacggtcttaccggaaagcccgaagcggcagaacagacggtccaggagatatgcgacccttgacatgtatccgcactcctccagtatagacaggcaaaggaacagtacgatgatctgcggcaggaatccgaggacggcgaacacccctgcgatgataccgtccacgatgaggccggtgagggccgtcgacacgttggcgtccgtcagagcgtctctgactgtgtcctgcagccatgccgtggcgttgtcgttgatccagtcggaaccccaggtcccgacggtctgtatggatatgtagtagaccgcgagcatcacggcgaggaatatcgggatcccgaggactctgttcaggaggatgttgtcgatcttgtcggatatggagacatccttcctcttcttctcctcgaacctgtgcatacagcttttctctatcctctctgcggcgtcgtatctctcggtggcgacgatctgcacaccgtcgtcggacgattccttctcgaatgcggagatgacctcgttggccttctccaccacatcggcgtcgaggtcgttgacgaccatctcgtcgcgctcgatcatcttgatggcgcaccatctctcgaggccgtccctgacctgcggtgcgattatcgcctgcacgtcggatatgcatctctcgagggattcggagtatgtgatggtcttcgggaccttcttcgagtcgtaggcgcgctggacggcctctcctatctccgaagtccccatgttcctgatgccgatggtctcgacgacctcgcatccgagggattccgccaattccctgctgtccaccctcatgccgttcttctcggcgatgtcgaccatgttgaggacgacgaccatgggtattcccaggtcggcgacctgcagcaggaggtacagagccctctccatgttggatgcgtcgacgatgtttatggcgacgtccggcttgctctcctgcgtccctatgagataatccctggagacgatctcctcgggggaatagggggagagcgagtagactcccggcaggtccacgacgaggatcctgtccttcgacgtgttcctgatgtatccctgcttcctttcgacggtgacccccggccagttaccgacgtgctgtatgctgccggtaagcttgttgaagaccgtggtctttccgctgttggggttacctatgagtgccgccgtgatcatagcgcagcctctccggattccgtacgatccgaggctgaaacgaggttttccagctctatgaccgaagcctcggtcttcctgaccgtaagcctgtacccccttagttctatctccaccggatcgcccaacggggctatccgtatcattttcacttctgttcccctggtcaggcccaggtcgaggacgcgttttctgagctgtccagaccctgataccgtgaccacggtggcggtgtccccgcacttcatatcttccaacttcattcaaaccaccgggaatttggcccaaaaccgagccttccctgaaggaaagtccggacctgggaactttcttttttccctggagccggttgttggggccggttcctctgagtccgatatgcgattactcattggtaccagcatggcgatgttatatttagccattcctaatcttagaatttcaatttaggatagattaaaaattatctccgtcgggatatcttacataatatgcgcgatatagtgaatcagatgaatggaagacggtcgagggtctccagataatatgtgggtccgcagtcgggccctatcgcccctcctctgtcgatgaaggcggtgtccaccccgcctgccgccccatctctatgtccttggggttggagctcaccacgagggtgttcgtcctttcggaccccatctccctcaggcagaggtccaggcaataggggtggggcctccgcaaggccatcctctcggccccgaccacggaactgaacatcttcccaagaccgaactcccccaggatctggtggatatgctgttcgtaggagtcggacacgatcccaagtctgcagcctatcccgtggagcatcgctatgcagcggcccgcatcggcgtagatggtcgtgccggcgatgacgttcctgtcgtacgtggacatgagcatggtcacgaagtccctgtacatgcacgtgcagccgcggtggtatttgctgaagagaacatccaacggcataccgtagtactccttctccttggatacgtcgaagggcatgtcgaaatgctggaacgccgtcgtgtacgctatgcggtatccgttcgtaaggtcggcaacggtgctcccgaaatcgaagatatagttctgatagaccatctgcgccgccctttcaaaatccccgttacagggtttgtgcagtcgataagggcatgtcgtttattgctctttcgagggattggatgatgttggatgtacacgcggtgatagttataaaaaaggtgattggctaactgtcatcatgcagaccgatatcgagatcgccgagagcgcaaaggttcgcaacatcacagagatcgctgcccagatcggactttcgtccgaagacctcgagcagtacggcaagtacatcgccaaggtccccctggacgtcctgaacaagaaagggacgaagaaagggaaactggtcctcgtgaccgcggtgacacctacccccgccggagaggggaagaccgtcaccaccatcagtctcatccagggactggcgaagatcgggaagaaagtcgtgggagccctcagggagccctccatgggacccaccttcggagtgaagggaggggctaccgggggaggcatgtcccaggtgtatcccatgtggaagatcgatctcgaattcaccggagacatccatgcggtatcggccgcccacaacctcctgtccgcggtcctggagaacaacctcgtcagggacaaccccctgaacatcgacccctcccgcatagtgtggaagaagaccatggacatgaacgcccgcgagctcaggcacatcgtcgtgggtctcggagactccaaactcaacggcggagtgacccacgagagcgggttcctcatcacctccgcttccgagatatccgccatcctggcactttccaccgactatgccgatctcaggaagaggctcgagagcatcgtcgtcgcctacacctacgacaagaagcctgtgaccgcaggacagctcggatgcgtcggatccatgatggtcatactcagggacgccctcatgcccaacctggtccagaccctcgagggacagcctgtcttcatccacgggttcccgttcgccaacatcgcgcacggcaacaacagcgtcatcgccaccaaggccgccatggccttcggggattatgcggtcaccgaagcgggtttcgcggccgacctcggaggggagaagttcatggatatcgtgtgcaggcagtccggcatcaggccgagtgcggtcgtcgttgtcgcatccatccgcgccctcatgatgcacggaggcgccgacctcaagaaccccgagtcgttcaccgccgacgcactggccaaagggatggccaacctcgacaagcacgtagcgaacatgaaaggctacggtatgcccgtggtcgtctccatcaaccacttctacaccgacgatcccgagcacatagccatggtccgctcccattgcaaggacatcggtgcggagtgcgtcatgtccgacggattcctcaagggaggggaaggtgccgtggagctcgcacagaaggtcgtcgaggtcctcgagggtcccaagcccgagctccagttctgctacgaggacggtctctccgtcaagcagaagattgagtctgtagccaccaagatctacggtgcggacggtgtggactacagccctgcggccgagaagaccatcgcccagctcgtcgaccagggatacggaggacttcccgtatgcatagcgaagacccagtactccctttccgacaatgcggagctcaaaggcgcacccaagggatggaggctcaacgtcagggaggtcaacctctctgccggtgcgggattcatcgtccccgtctgcggaagcatcatgctgatgcccggtctcgccaaggagccggccgccctcaagatcgagcttaccgacgacggtaagatcgtaggcctcaagtgagaaacccttccacggatgggcgggagacccccgtccatccacatacccagtatgtaaaaaacctatcagaatgcgggtgcggccctgttcttgtcatccgccatgtcgtaccagcgtccggcctcttcgtggtccatgtccaccccgtcgcccgtctcgtacatgtcgcccagaaggatctgcgcacctttgtggccgtttatggccgccgaggagagccacctcacgctctgcttctgatccttctccactcctgcaccgctcttgtacagctgacccagtatgaacatggcctcgatgtttccgttcttggcggactgcgacatcaggtcgaaggtcttggagaggtcccttccgacaccgttgccgtccagatacagaagacccagagcatactgcgcacgcgggtccccgttctccgcgggcttctcgaacagctccgcggccttggccgggttctgctcggtgccgtatccgcggacgtagatcttgcccaggaagtacatggcgttcaggttcccctgttcgctcgcgttctccagccagttcctggccagacggaagtcgcgggggacgccctgacctctggcatagatgagacccagatagaactccgcctcgtcgttccccttcgaggcgtacgaggacagaatggccatggccgccccgtagttgttctcgtctctggtgcggatgacgaatttcgcccattcgagcgtatccatacacccatcaggccctttgctcatccatcatactaacccagaatgaatataaatcggttctgggggagctgcatacaaatccttacgcgtgcgttatagaaacataaaataaaatattgaatggggcgtagagttggaaaatgaccgccgataccgatattgtagctgaaagacccgccgccaagatacgcggccttatgaacgtgtccgggacccaggatctgaagaaggcctgtgccgcagccgaagggctcgccggggacgatgcggaatccgcataccttctgggtctcttcaagtatgtcgggaagggcacacagcaggacaggaaggcggcatccgaggaattcgccatagccgccggaatggggtcccaggaggcatccatcgtggccgaggagatcgggcgtaacccggaggatgtccaggagcgtctcatggacctccgcttcagggcggagtgcagggatctcgcggcgtgcagggagatattccccctttacgacaccgggaaggacgggaacggatgcaaaggtcccgccaagaagaaccatgccgaggccataaggctctacatgccctgtgcggattccggggatgcggatgcccagaacacaatcgggtacatgtacctcatggggaagggggtctccaaggacaggggtctggccctcaggcttctggagagtgcgtgggagaacggatgcgcccaggccgcataccgtatcgcctacatgtacgacagcggtcaggatttcgaggacccggacctcgataaggcgtacgagtggtatgtcaaggcatccgacatgggctatgctgatgcggagtacgccctcgcagggataatgttcatgcaggacggcccctaccgcaacgtggcccgcggggtcaaactcctgataaaggccgccgaccaggggcagcacgaggcccagcaggaggccggtatgatgtatgcatacggcagcaacggcgtcaagagggaccaggagaaggccgtgaagtatctcgaggccgcctgcgagggaggggtccagcaggccatgaccaactatgccaacatgtgtttcgagggacaggcggtgccccgtgacatggcgaaggccgcgaaatggtttaccaaggccgccgagaactatgacgggatggcgcagtacgccctcggatgcatgtacggcaacgggtattacttcgaccaggacgacagcgaggccgcgaaatggttccaggaggccgccgagggcggggagcccaattcccagtacgccctcggatgcttctattacgaaggcagggggatagagaaggacgagaagaaggccgccgcctggttccaggaggccgccgaccagggccacctcggggccatgtcattcctcggtatgttcaagatcaccggcaaggatgtagagcaggacatagaaggagggctggaactcctcaacgtcgcggccaagaacgggtactgcgaggcccagttctacctcggtaagctgtatgcggacggcgagtacgtgaaacaggacctcgcctacgccaagaagatgctgtcgttggccgccagacagggggatcccgatgccgaggtcatgctccagcagctgaagaagatgaaaagacgctgacgggtgcggtcgatatcagacgggggctttgaagatggatgcgaagatacagaaggcagccaaggagggcaacatctacgccatgctggccatcgcctacatgtatcagaagggcaaggatacggacctcagccccgcagacgccgtcatctggtacgagaggtcggccgccgccggatgttcccgtgcgaaatgggagctggccaagatgtacaggttctccgaggtgcccgatcccgggcgtcagaagtatatctactggctgcaggccgccgcggatgcaggcataccggaggccaggagggaactgtccgccaggtacttctacggcagccttctgccgaaagacgaggagaagtccatgtactggataaggctggccgccgagggcaacgacccgctttccgaattcagatacgcctatgccctggagatcggttacgccggacagcatgacccagatacggcggccaagatgtacgagaagttcaacacctcgggggatgcggagcttttcttcaagatcggacagaacttcgagttcggtctcgaagggtgcagggtcgacatcaagagggcctgcaactactaccgtatgggtgcgaggatgggtcacgacaagagttatttcagcctaacaagggcggtggcgaccatcgaaggccgtcagaggcaggactccttcatggaaaggaggaatctcatcctgcagaccccttccgcactggaggaggagaagcgcgacgggaccctcgccgaggcggacgaccttatggaagagggacttttcgaagaggccatcgacagataccaggagtcggccgacctcgggaacaccgatgccatgttcatgctcgcgatgctctaccatgacggaagcatagtcaggaggaacgaccatctggccttcgagtatctgaccaaggcgtccctcagcgggtcctgcgatgcgcagctcttcctgggcaggagttacgagtcggggcgcggaaagaacaagaacatagaggaggcgattaagtacttcgccatgtccgccgctggaggtaacatggtcggatactattatctcagcaagtacatgccgcgtccagagctctacgtgaggagcacccagaggatagtgaggtgaatgggactcagggaagtcatggataaggcctccggaggcgatccgcgcgcacagaatgctctgggatattattattacaaaggtgacggaggggtcgacagggatgtcgacagggccttcatatggttcaatatggccgccgatgcaggggacccggagggcgaatgcaacgccgcctacatgtacgtccatgccgagggcaccaatgccaatctggaggaggccatccgtctctacacggattccgcagagaagggatatgtgcagtcgatgttcaatctggcacatatgtattcggacggtctcggggtcgagcaggactggtccaaggccatagattggtacaccaaggcgatggatgggggttccgccctcgcctgttaccgcctgggcgtcatctacgaggagggccgcggcgtggaaccggatccgccgaaggccgcatccctgtataggaaatgcaccgagacgggttacagcaaggcccttgtgcgtctgggcgtcatgacgttggaaggccgcggtgtgaagaaggatcctgcggccgcatccaagctctttctcaaggcctccgaggattccaatgcggacgcctatctgtggctcgggaagatgtccctttccggagaaggcatggtgaagagcgtcaacaatgctcgtaaatggctcaccaaggcctccgtaagggggagtgaggaggccaaggacctcctcgggatgcttcccccgagatgatcagacttccaggcccatgacgttcatgccgttctcgtctctgcagaggcgcatgaatccggccctttcgtattcgcatacccgtccgtcatcgcatctggccgtgacggagcacgatccgacggtctttccgcactcgcagaaaagctgggcggcgcttcttatcagggcctcctccaattctgcggggccttccgcacctatgcgatgtatggtgtaggccggatggtcgaaggtgcatccgtcggcggccaggatcgtgaagtagcctacgacgcggtcggactccgaatccacggcgagatatgtgcgggagaggttttccaactccccctccatggcctcccccgccaggaacctctgtccttcggggtcgctgcatccgtcgtaggtggatatcaggcgttcggccctgctgtcctcggtcatggcatcccggagccttactatcacgccgctcatctgcaggccccctcgagatatcttcttccctcggccaatagcatgaatacactctcgtcgttcttcgcaaggtgtccggtacgtccttcgcaggccctgtatccgttctctattctgtttctgttcttccttccacatctcatacctatcccttgacggaaccattggcgtgtatggtttttgaaactgaatattgcagttaaccgggtgcgatccatgatttccgatggaatggataataaaggtcaccaatcaggtatataggactttgacgttcgcaaatcaacagaggccccatcatgaggatgaacaactaccaggcggaagccataatgcgtgagctctccaccataaaggagaagagcgagttctacaggaagaagttcgcggacatcgatctttccaagatacgcacgcaggaggatttcgagaccctgccgttcaccgacaagggggacctccgcgaggcctaccctctcggtctggcggccgttccggagaaggatatcgtcaggatacactcctcatcgggtaccaccggcacccccgtggtcatcccctacacgaagaaggatgtcgaggattgggccacgatgttcgagagatgctataagatggccggcgtcaccaacctcgacagggtgcagatcacccccggatacggtctgtggaccgcaggcataggtttccaggccggagcggagaagctgggtgcgatgacggtccccatgggtccggggaataccgagaagcagctgaagatgatgcaggacatgaagaccaccgtgctctgcgccacctcctcgtacgccctccttctggcggagaacataaacagccggggcctcaaggacaagatctgcctcaagaaggggatcatcggctccgagagatggggggacaagatgcgtcagaggatcgccgacgagctcggggtggaactatacgacatatacgggctcaccgaggtctacggtccggggataggtatcagctgcagttacaagaacggcatccatctgtgggacgactacctgtatttcgagatcatcgaccccaagaccctcaaacccgtccccgacggaacggtgggggagttggtgataacgaccctctgcaaggagggggccccgctgataaggtacaggacccacgacctcaccaggataatgaccggtacctgtccctgcggttccagatatcccaggatagacatcatcaccggcaggaccgacgacatggtgaaggtgaaaggggtcaacatgttccctgcgcagttcgacgaggtcctttcggcggtccccgatgcgagcagcgaataccaggtgatgatagaccatctcgaaggcaaggacatcctcaccctgttcttcgagacgcccgcccccaaggagaggtggcaggatatcgagtcgcaggtcgcggagaagttcagggaggtcgtggggccgaccatcaacccgaaggcggtgaaggtcggggacctgcccagaagcgagaagaagaccagcagaatcttcgataacagatactgacggttccattcggaggggtcttccgggcaggatgtgtccgtccgggaggtccctttcttgaaatcgggccccgtttacaataccggtccacgatcttcggatacggcgtatttgttgtccgtatcctttttcatttcccgtaaagggtcgttcgggaccggtcataccgtgtccggtctaaggccaataatatgtattccagcagaccggggggtcgaaggatcagctcttcccgccggccatgacgagatatgccagcaatgcctccagctggatcttctcgttgctcccttcgatcagacggaactcgatctccccgatcttgtcgacgagcctcaccttgtccctagtctcgagggggagtgtgaacacggcggagtggatctgtcttatgacgtcctgtccggagagtccgtagttgatcattatagtgtcgagtttgttcctggaccctatgaaatcgccgccgagggcggtggtcagtatctcgaggacgtccttctcgttggccgtaccggagaccttggatacggtgtccgcggtgatggtccctccgacggaggcggaggtctgcagggtgttgacggccttcctcatgtcgcctctggctatgtacacgagggagtccatggcaccctcctccatgtcgaggttctcggacgaggcgatcttctcaaggaactcgcggatgtcgtcgtcgttcagcggacggaacctgaagacggcgcacctggattggatggggtcgatgatcttggacgagtagttgcaggagaggatgaagcggcaggtgcgggagtacttctccatggtcctcctcagcgcgccctgggcgtcgttggtgagggcgtcagcctcgtcgaggaagattatcttgaactcggctccttccacgggggcggtcctcgcgaagtccttgatcttccccctgacggtgtcgatacccctgtcgtcggaggcgttgagctcgatgaagttccccttccagctctctccgaacatgcctctcgccaaggcgagggcgcaggtcgtcttcccggtacccggggagcctgcgaacatgagatgggacatgttcttcgcctcgacatatcccttcagcctctgggtgacgtccttctggcctatgacgtcgtcgagcgacctgggtctgtatttctccgtccaaatctcgttcatggaaaacatccatgcgatggcatccgcataaaataaactgtcgcaggaagtaggatgggccggacaggtatgtacgtcgatagtcgtatacaatgttagacgattgataacattaaataccatcccgcccatggatgcccatggccgacggatacgatatgccgaccaggaaagcgaaccctgcacctctgggtcttctggggttcggtatgactactgtgcttctgtccctgcacaacgcgggaataacccctttggacaacgtcgtccttgcgatgggggcgttctgcgggggcctcgcccaattggtggcggggatcatggaataccgcaacgggaacacgttcggtacggtggcgttcaccatgtacggcgtgttctggatgacgttcgtggcgatcaacaccggactgttcgggatgggttccgaggggaagaccgtcggagcctattgtctcgtgtgggggataatgaccttgttcatgttcctcgggaccctgaagggacgcatatcctccaagttcgtgttcctcactctgaccgtgacgttcttcctgctggccgccggcgacataggcggattcgaggtgttgtcgaaggccgcaggcgtggtgggtctgatatgcggttccgccgcgatatactccgcggccgcggagatcctggaggagcagaacggggaggaggtcctcccctactgacctcccgttcccgggggatcggaaggcccccgggacatacagggtacatgtgccagatcccgatcgtgagatatcgtccccgtcctctgtcggcgatccctcccggatgttctgcaggggtcgtcacaatcgccgccgggcgggatgccagcattttttaaagtaaataccatactgcgggaatatgaagatatacgacgcttacaagcttgccatccagacgggtatcgatcacgacccccgtccgaggtccgagatcgacctcgtcctgagcaaggcgaagaaagcgtacgacgccctcgacgacgacaagaaggaactcttcgacaccgagagcctctggaacccctactacgattgccgcttctcctggggggaggacatcgcgaaggagaaggaggcacagaggctcatgtggggtgtcgacatcagcaccgccgaggtccttctcgccgacagactcagggagaagggggaggagatcgacgccgtcgtatgccaccacccgctggggaagtcgaggaaccccttccccaaggtcatgtggatgcagaccgacatctatcacgactgcggcgtgccgataaacgtcgccgagggacttatgaagccccgtatggacgaggtcctctacaacgtcggaggcgacaacttcaaccgtgcagccgacgccgccagactcctcgggatccccatgttcaacatccactccgccgccgacaacatggtccaggagtacctggagaacaagatcaaggaggcggagcccaaacgtctgcaggatgtcatcgaccttctgatgaccgaacccgaataccgctacgccgcgaaactgaacgacccgccgaagataatcatcggtgacaaggagtcccgctgcggaggcatcatcgccaagatgaccggggggacctccggacccaccgggatatacgaggagctcgccaaggccggggtcggcaccatcgtgggcatgcacttcccgaacagtgccgtggaggcctgcaggaaatgccacatgaacatgatcatctccggacacatgtcctccgattccctggggatcaacctgatctgcgacgtgtgggagaagcacggcatagaggtcttcgggaccgccggcttcagtcgtttcagcaggaactgatcatgttcgaccgccgttccatcatcataaaggacggtacgaagctcaacttcgactacgtccccgacaccatagtatgcaggcaggagcagcagaaggagctggagaacttcttcgcccccatggtgaactacggcaacccctcgtccgccttcctgaccggaggcgtaggtacggggaagaccgtcaccgccaaacgcttctgtgccgacatgcagagatatctgcagcagaagggcgggatgatgacgacggtgtacgtcaactgcaggataaagaacagcgagtacgcgacggtcctggagatcctccggagctacgaccccatgttcccgggcagggggttctccatcgagcagatgatggtatccatcaggaagcatatcgagaaggacgcatgtcccgtggtgataatcctcgacgaggtggacgtcctcctgggaaacaacgggaaggacataatctatcagctttccaggtattccgaggagacgaagggtaaagcccccatctccctcataatgatatcccagacatcgatcgcagagcacctggacgaggcgtccatgtcctccttcagaagaggaaacaaggtcaccttctcccgctattcccgcgacgagctgaaggagatcatagtgaccagggccgagatggcgctggtccccggggccctgcccgaggagtgcgcggacatgctggcggacatcgcggcggagatgggggatgcccgctacgccatcgagtccttggagaaggcggccgtcaaggccgaggccgacggggacgacaccatagtcccggacggggtcaggacggccggttcatccgtgtacagcgacgtctcggagaacaagctcaaacagttggacatgagccgcaaggtgaccctcctggccatagcccgctgcatgaaggacaaggcctccgtatccagtacggccgcggagaagacctatcacgtggtgtgcgaggagtacgaggtgcccgcccgcaaacatacccagttcgccacctacatacaggatctggagaagaacggtctcataaagaccgagacacgcagggaggaggagggcggccgtgccttgtacatatacatcatgaacattcccccgaaggagttggccaagaaactggagtacatcatggagacggatgccgtggaagagggttccgaatgaaatgcgacctatgcgggaacgatgccgtcaccttcgtgagatacaacgggacccatctgtgctccgaacatttcatagattatgtggagaggagggtcaaaaaggagatccgcaaggagatctcgctttacaaaggggacaccgtcggggtggcggtctccggagggaaggacagtatggtgaccctcagcatcctccactcccttttcaacgagaggaacgggatacgtctcgtatgcatctcgatagacgagggtatcgacgggtatcgccctccgagtctggatatcgtgaggaggttctgctcggaggagtccatagagtacagggagcgttccttctccgagctgggtctttccatggacgaggtcgcccccgtgtcggggagcagcagcccctgtacctactgcggggtcttccgccgcaagctgatgaacgacgaggcccgcaaggtaggggccaagtatctggccacgggacacaatctggatgatatagcgcaatcggtcatgatgaacatcgtgaggggagacatagaacgcctggcacgtctgggcccccatacgaatatcaggcccggtctgatcccccgtttctacccgctcagactgatcccggagaaggagtccttgttgtactccatcgtcaaggacatcccccattgggacggggagtgtccttactggcaggcggccctgaggaacgagtaccgtgacctggtggacggtctggaggacaggtctcccggatccaagttcagcatagtgtcgtcatacgataaactgaagcctatgctgacacagacctactcccccgtgaccgaactgaagttctgttcctgcggggagccttgcaacggatcgcgctgcaaggcatgtgaatacgaggattatctgatcaagaggatcagaggtctctgaaaggtaccaggtcgcagcatccgcattcgaggcacatggtcttgcacgtacgtgtgtccatgccgtatctggagaggacgtccttgtgtatcctggcgacctccaccatctcctccggggtcacgggcgcaggttcccctatggccttcttcagggattcgccgttgtacttgttgtgtctgagggaacggaccgtggggatgacaccgatctcgcacagctggcacatgcatttttccaggtcttcgtgggtttcccccataccgtagattatgttggaggtgacatgacccttcccgaagtaccggaccgcatgacccagacatctcaggatgttctccctgtcgaggtcggggcacactttagcgaatatctccggggtggccgcctgtatgttcagctttatctcgtcggcccccgcatccttgaacgctttgatctgggattcgctgccggcatacggttcgatcccgatccttatgtcggggaggaccttcttcaccgcctttatgcatgagatgaatctgtcggccgtgcggtcgacgtcgttgtccatgacgccgctggtcagggatacggccaccacatgcatctcgttgtacgcgtcgaggcatttcttcgcgatatcctcgtcggtcaggcccttgtagtcggcggccgggagtctgggggatgcgcagaacgcacatccgaaggagcatctgggatccaatgtgaagaacgcctgctccggacagtggtatacgaccggatcgaaccttatctcgtcgatgaacggttccccttgatgcgtgagatagaggcttccgtcatccctctcatggagttcgaactcccctctatcataggagacgctcttcttcacacgcattccgtggaaggagaaggcgacggagtcgcctcccgctcccggccctgaagtggaatgggacaccctgacgggtatctcgaatccctctggcagctttatgcctccgccgagtgccagcgtggccttcttaaagatcagatcttcttccatttagccccatctgccgaatcttctatcgcatatcccgcttcggaaaggcggtcgcggatcatgtccgccaggtcgtattgtttgcgtttcctgagttctttcctcaggtctacaagtatccccatgacgtcggcgaaggatccgtcgtccttctccttctccgggaagatacccagaacgtcgtcgatctcgtcgaggaatccgaggacggtctcggccccctctttcgttatcgtcttgtccgccagcatcttgttggtggtgcgtgcaaggtcgaacagggactctatggcggcacgtgtgttgaagtcgtcgtccatggacgatgtgaatccctccctcgccttgcagatggcctgtgccgcgttgtccgggcttccggaaggtccgtcgcgtgcgcatgcctggaggtcgcggtagttgttccagagcctcttgagggcggcctgtgcctcaagcatgttctcctccccgtaggcgagcgggctgctgtagtgggtgttgaggtagtagaagcggatggtgtacttgtcgaacttcttggccacatcgtccaccttgaagaagttcttcagggatttggacatcttgacggtcttgccgtcggaccctttggtctccagcatcccgttgtgcatccaatagtgtgccagatgggacccggtacatgcctcggtctgcagaatctcgttctcatggtgcgggaagatgaggtcgttgcctcccccgtggatgtcgatctcgtccccgagatagtgcctgatcatggccgagcactcgatgtgccagccgggtcttcccttgccccagggggaatcccaggagacctctccgggcttggcgcctttccatacggcgaagtccatggggtcctccttgtcctcgttgggttccagccttccggaggacctcatctcttcgatggacctgttggagagtatcccgtagtcggggatcttcttgaccctgaagtacacgctgccgtccttggtcggatagccgtagcccctgtccactatctccttgaccatgtcgatgatgtacggcatgctggtgctcgcctgggggtagatgtccgcacggcggacgcccagtttctcgatgtcctcgaagtacttcttgatgtattccgcgctcaggtcgagggcctcgatccccctttcgttggcgcggtttatgatcttgtcgtccacgtcggtgaagttggtgacgaacgtcacgtcgtagccgaggtagcggaggtacctgttcaccacatcgaacacgatgatgctcctggcgtgtcccatgtggatgtcgtcgtagacggtgaccccgcagacgtacatcttgacttttccgggctctatcggtacgaactcctctttcctgttggtaaggttgttgtggatcatcaggctcattctctcaggcctccttgttcttcttcagggactcggtgagggtgcggagctgttctatctccacctccatcctgtccatgcggtcttcgaccacgtcgggaagatggttgtgttccaggacgtccttcatgtcgacgcggaccccgttcctgctcacgatcctccctgggaccccgaccactgtgcagttcgggggcacctccttcaccaccacggagccggcacctatcctcacgtcgtcgccgatggtgatgttaccgagcacgatggcccccgcccccaccactatgcggttgccgagggtggggtgccttttctccttgttgaaggacactccgccgagtgtgaccccctggtacagggtgacgtcgtcccctatgattgtggtctccccgatgaccacgccggtggcgtggtcgatgaagaacctctccccgatggtggctccggggtggatgtcgcatccggtctcctcgtgtgcctggaagttcagcgccctcgcctcctccagtttgccggccagccagagctcgtggctcttcctgtacatgcataccgcacggaatccggtgtggtatttcttggcgtcttcctcgtcaattattgcggggtcgcggtccatgaccgccttgaggtctccgggatagtagtccatcttctatcaggctctaatccaaggcacagtaattaaggattatcaatcccgcacgcgcgtactgtcgtccatatgatgccataacttatattaacaattgtttatacaaatatccggaagctgtttgttcccggggcggcctcctgccgccgccgggttcagtgtctgtgcctgacggcgaggccgattatcgccaggatgatgacgatcccgacggccccgaggatcttggggtccatgtcctcgacgtatccgaggaccttgtcgacgaccccctcctccgtgtacaccgcgtgtatcgtgaggtcgttcggaccgatcctgtacttctcccacgaggctttgtatccctccttgggaggtatctccggttcggggagggacttgtcctccaccgtgaactccacggtcgatacggtgacgccgtcgatgacgaaggcggcggtataggttatcggggtgtagaccgcgttcaccgtgacgttgtccaggatcagggtgtaggcctcccagaccccggtgtatccggccttcgggggcacggcgggctccgtcacggtatcggtcaccgattcgaactggatggttttgacggtccttccgtcggccttgaagtagatgttgtacacgtcgacccattgggcatagaacgtcacatccccggtcacggtgtattccgctccggcagcgtatttcgtacctccgaatccggggtcggtgtaccatcccttgaacgcatggccgctccaggagggttcctcgaggatgatgacgtcgtcctcgttcttcatgaccggttggatcgcatctcctccgttggtctcgaacgacacggtgtacgaagggggagaatacgtatcggaggcgagggtcgggatggagaacatgtcgctgacagtggacgggtcatgcgattcccccacggttattgcgggtcccgacgaggtcagcatccccatcgtattcgatcctgcgagcatatagttgtagacggtggtcgtctggtcgtcccatgtgcagtccaccaggtaccacttcccgtcatccatcatcacatagttccacatatggccttccggggtgtcgctggaagatcctttggcttctccggtgacggttatgcaggggatgccgtaacggtcgcataggagcttgaaactcttggcgtatccttcgcatactacattgcggtctccggccaatgcggtataggcggagcgtatgacggatgaattctcctcgttgtccgtactggaataagtcagggtggaggcgagcccgtcatgtatagacttgaccgccgtgtacctgttggtattgtctatatggaagttttcaacagcttggtcgaaggcggccttctcctcactgttggtggagaatgcggtagggaaggaataagtgatggtcccgcctgtgacgatgtatttcagtcccgtgcccatccaatacagttcgggcttttccgagacgagagccatgcggatttcggacagggttgaatcaagggtgtgttttacattcgttacggaatcatcatcgaaccagtccatgttcaatgttatgtcgaaagacgattctcccggttccaacgtcagggccttgtcgtagacggcctttcctatctgatccaattggtcgtagtagtatcttgtataatcgtcgccggtggcctcggattcctcggagaggacggtccatatgacggcgacggacatcagggcgaccgctatggcggccatttttttcgcatagccggaacggcggtatgcggagcctgtacgggacatactgttgtaccagtatggagatattaaaccgtttttcggggccggtccttccggcccccggaggtctcagtcctcgaacccctcttccttctccttcgccgccggggcgaagttgacggcggggcagggaccgtagcagtgcatgcagaatatgcactcgtcctcgtggatgcggaccttgccgtcctccatgtagagggcgtgggaatcgcatctggcggcgcagaggccacagccgacgcagttgaatgccctggcgatcagctgtgacgcatggtccatctggttccttgcgtcgttctccacgaacgccttgctcacgatagaacccgcgccgtagaacgtgacgtagttggcggtgaggctgtcctccgcctcgttaaactgcacgacccagccgagggcatgggcgaaaggctccagcttcttcaggtctatgggcctcgagagtgcggcctctatactgtatcccagtgtgcagggggagtatccgtcctgcacctttatggcgaccgggccgtcgtcatcgtactcctctttcttcaccttcatcgggggcacctccttccccgtgaccctcttgatctcgtccttcacggactggggggcggacttccatctccacaggccgtatttcttccattcctcggggagtcccgccttccgggagtattccgtcaggtatctgtcccactccgggtatctggaactggcacgggacaccgtgtcgatgtcggccatgtcggaggccggacacatgaagcaccctatcctgtccaggccgtgggcgtaccacgtgttgtaaggctccttcttgtagaagatatagagccagacgtgcatggccatccagttctggatgggggaggctccgatctgtccgggggtccaggggttcttccacaccctgggcttggcgttcctggcctccgactcgtacttcctctgaccgatgaaagagaggaccccatccgggaaattcttggtgatgaggctcacggtgggaccgagtttgttcgtcttgcagcaccacctgtagtccttggcgggcggaccgaagtagaccaggttcccgaagaaggcgtccttgggaggttcctgctctatgagtgccagaccatgtcttttcgcgaattcgtggacgtattcgacggtctcgtcgagctccagtccggtgttcacgaacatgggtctgatgtccagtcccgcatccatggtgaggagcatcgtggcgagggagtccttccctccggagaaggagaccaccgtggggagggggtactgctccatggtcttccttatgaagtctatggcctcgtccctcctcttctcgatgatcccgcggttggcctccaccgcatcgtcccaggaatgtgccagattcgatgataccatggcctcgggcttgtgccacctggtcttcacggatatcccgtggtccgactccttcatctctgtacccgtcatcttggccacccccgtaccgatgacggtcctgtccgcggtgaccattatgacctcgtcgtcctcttcgatcccggggtcggcgtccaccactccgggggccatgaggttcctgttctgctggatgaacgggacggcctcgtcctctatcacgacccagcctttggtcatggtcccggctatcctcatggccccctgcatgcggatgatgaacctccatccgacgccgaggtcgtatctgagggtggcgaccacggtcccgtcggcgaggacctcctccatcctgtctatggcaggggccttgttcatgaccgccaggtgtccctcgggtatcaatgccatgccgcagccttccccgaagcatccgtcggccatcgccctcacgcggtcgatgtcgtggtcgaacgcgggacgggagtccgccggcggcgtgagctcggtcacgtatgtgtccgtgccgcagacggggcatgtcttcgattccataattgggaggttgcatttggggcaccacctgaggtggttcttgcccagcttggtcatggccatgcccgttatgtagaaagacggtggatttatactgttggtcaggttgggtttttataccaaatactgtgtagaaagggaatcgtatgaaaaaagccgcgtttggtgcggctatctgtatcggccggaaggatgggatccgtccgatgcctcgaagtgatcagatgcaatacacgtacagattacgtcccatcggaaggaatgccttcataaccgcccttgtcctcacatgccttttggctacgtcgttatacacgctatcgtccgcggacgggtcggatgcggaaggggagggatatctcgtgtccttcgacgtctgcatgaccggggacggttcgcccgcgaccccctattccatgaggaccgacgcatacgggtcgctgacgtcctctctaccccgtgtcgagtgcgacggatacgtcttcaacggatggtacgacgccgacggcaagaggatcagggtcaacaacgtattcaccgaggacacgaccgtctacgcccattggacgaggacctcttcggaccctattgtggtcctgttcgtgataaacatggtcggggacgtcacccccgcctccccggccgggagactggtcctccaggacgggaccctcgggacgctcccggaaccctccttcggcggattcaccttcaccgggtggtatacggatgcggagtgccttccggaacagagggtgtccacgtccatgcactattcctccgatacgatgctctatgcgggatgggacgccgacagcgtctcctcccacttcaccgtctccttcaagtcctgcatgaacggcctcgatgaccctgcggatataggcacaggggacgatgcgagggtcggagacctccccgtcctgtacaggggaggcaaggtcttcgagggatggtacacctcgaacggtctcgaggtcacgcagaccactgtcttcacatccgacgtcgtcgtctatgcccactggtcggacaaggagaaggattgggtgcccatcctgtgggccctgctgatctccgtcttccttctcgccgccctctggaggatcgacgggcactacaggcacccgctggccacggtggaccgcatacccacggcgtccgaggacgagatcaggaggtatcagaccgcctgctacgccgatatcgcggagaggcagggcagggtcgcggagatgtccgccagggtgaaagcgctctccgacaggaggagggtcggtacggccgatgcggaagaggaagaggagctctcggccctccgcgggaggctggaggcggagaaggaggccctccgcgaggtcaggaggaggtacaactccgagatgaggaccatgtacggcatcgacatcacccgcacccctctgatattctacgaggtccgcgtcctcctcctcgccctataaactataaatgtcttccagtatgtaaggcgcaaaaagaagtgaaatgccatgcagaagaagattaaggcatccaggcgctcgatgggaatgaactacgcgatccgtgagatcaccgtacccgccgccgcagctgccgcgcgtggcaccaagatgtacaacttcaacatcggggaccccaacaaatgggacttcgagacgcccgagtacttcaaggagaccctcaggcaggcggtggacaggaccgacaacgggtacggggactcccaggggaacctcgacctgagacaggccatcgtcgacagggagtacgagaagaacggcgtctcgataaaggcggaggacgtctacgtcaccgccggggtcagcgagtgcatcaatgtcatgatgggtgcgttcgtggagcccggagacgagatcctcgtccccggacccggatatcccaactatgcgcagtatatcaacttctacgaagggaagaccgtcccgtacaggatgatagaggaggaggattgggcccccgacgtggatatgatccgctcccgcatcaccaacaggacgaaggcgatcgtggtcatcaaccccaacaaccctacgggagcggtctacagggagaaggacctccgcgagatcggcaacatcgccgccgagtacgacatcccggtcatctcggacgagatctacgacaagatcgtcttcgacggcgagttctattccatgtcccgccttcccgacgacatacccagagttatcctcaacgggttctccaaggtcaacctgatgcccggatggagggagggttactgctatttcatggacaggaacggtctcatggacgagatccgcgagggtatgatgaagcagttccgtgccaggatatgtgcgaacgtcccctgccaggaggcggcgagggtatcgctgcagggcccccaggattacatcgtggacatgaacaggaagctcaaggagagggcggagttcagttacaagaggctcaacgagatcccggggataagcaccaacaagccccacggcgccctgtacatcttcccgaagatcgagctcaccgactggaagacggacaaggacttcgtatacgacgtcatcgacaagaccggcgtcgtcctggtccacggctccggtttctgcgaggagttcggacaggggcacttcaggtccattctgctcccgccgatgcccgtactcgaagaggcgtacgacctcctcgagaagttcatggtcaagcatcagtgagacgttccaggcggtcttttccgacaaatcccgcttgtaacggcagtgtatccgacagaatatggcggccggatacgggtctcatccccgtacccggtcctgtaaggtttattgggggttcccggtcggcgggtcctcgtacatgtacttcttgcacagggggatgagtatccctccgacggcgttcccgactatcaccacgaggatgaagaggaaggcgtcgagcgtgaacgtcccggaggcacagaagtagaacatgtccgctatcgagtgctcgaacccggccaatatgaagacggggacgcatacgaaggtagccagatactttttctgggtcttgtagtagtctgcggcgatgaacatcagcataccgcagaacacgcccttgcagaacacgcgccaccagtctatgtccccgcccagtttcgcatcgactatcaggacctcggccgcttcgggcatggggatcatctgaccgatgatcagcgctccgacgaagttaccgaggatgatgacgacgaggtccaccaggtacgaaggtttgttctcgacggcgtatcccaccttcccggtgtagaggtccaatctgaacgtgaagaccgtgaaaagacctatggagaagaggatcgccccgacccatttgtattcggacgtcaccatacccatgaagatacagccgcccagcccgatggcgatacccgcgagtatggccctcaggaagcatttcatgtaatgttgtatcattttttacgcaccccataagactccgcacggtttctcctattgtatcgaacgggacaggcgggcgtctcgatggtttacgtttatcgggaacctcgctccatcgttatgtagattgccgtctacggaacatacggcatatgtcgaactccatgactgccgaccatttcccccatccgaaaaggaaccttttcatcagaccgcggacggcccatacgcacacggcggcgaccagtgccccggccaggatgtcggtcggccaatggacgaacagatagaggcgggagaacgccacgaacgcggcccagacgagggcggccgccccccatttcctgtcatatatcaggaccgaaagtgccagcacggacgcgttggcggtgtgtcccgaggggaacgagtagttggtgggggcggggatgaggaggttcaccggatattccatgaacggacggtccctggcggtgacctccttcagggggatttcgaacaggatgtcgcagacggcctcggcggcgaacaccagtatgccgagttcgcgggtcctccgggggaccatgagcagaagtgccagacagtataccgcggccccgctggccaatatgtcggcggcctcggaggccaggtccaggaacgcattggacatgttgtcgcgtatccatatcaggacatccagttcggacacggacatgattcggagtacgcgtataaatatggtcgggacggatcctgcgggttccgatgtatccttcgctagcccgacggatccgatgtctcatccgtatcggattactgagtatgaagaccgaagggatgtcgatgatgtgacggccgtgtcatatgatccaagatcatcggatcctccgccggcctacatggattttcatgtgatttaatcaaacgatcgaccaatatccggtcaatttatcccggcattggaattgatgtcctttatcgcagaccttatgccgctccatatgctcatgtcgctgaacagctccgggatcgtaccgtagttggtgaaaggggattctgtaagtacggatagatccgatatggccccgttacgaaccacatactctatgatctggttgacgaaatggatctgcttatcatccaatctggattcatccaggtatttggagaacgtcttcttggccgcattcatgtcgagaccggtgatctccctgatgaacagtgccagaggtttgttcccgtactcggcctgatagtcgtctatcgtgccgacctcactccagaggatctcctggagtttctccacgtcgccatcgtccagcgggacattggtcttcagttttttgatgacatcctcgtcttcatgggtacggatataatgttcggccctctcgcgatacgagctgaggccctcatccgtcaattcggacggattgatgtctatgctaagtatctcgtcgatgaaattggtcttcttggaggactttaccttggaagggatgtatttcattatgtcgcgaagatcgacccttatgcgttcatatgtttccaggtctccgttctccagatatccgtcgcggaggacgtactcgatcgtctccctgcggtcggcgacgtccggtatgaccatttgcttggaaagcgcatccgcccagtgtctgaccttcttgaagagcatcttcttgggcgagtcggtgatgtatccgcgctctatcatcagcatgagcgcatccatccttatggcgcccggatcgtcatcgtacggcaatatgaggtgcgacagttccgcctccatctctgcgacatcctccaaggtcagggaatccaatacctccggacggctgtaatgttccacggcgcggaggtgttggatgaccgcgaagttgtctttgttgagctcatcgatcttcttcttcaggtctgcgacgatgtctttcctgaaggagatgtaaggttcggacctgaagccgagttcctgcagcttgcaggccaccaacgccttgacggtgaaaatacggccctgtatcgtatcctgctctttcacggagatccctttggggttgaccctgaagaactcgaaattcctgcagaagtcgaatatgtagaaacagtccttgtcctccccgtcgatgagccccggacagagtctggtccctctcccgatcatctgccagaacttggatttgctgtacacgggcttgaagaacaccaggttgaggatatccgggacgtcgatccctgtatccatcatgtcgaccgagacggctatgcgtaccgtggattccgggtccttgaacttgtcgatcatgttgtcggcataggagtagtagttgtcgatgacctgacattcgtcgaggtggctgggatactgttcgttgaacacctcccggatgaactcggcgtgctcgtggttccttgcgaagatgatggtctttcccagaacgcttccgtctttgatcttcagccccatcctcatgagggtgtcgaggacgcgtacgaccgtatcgcggttgaacagccatttgtttatcttctggctctcgatcttctcgggcaggacctcgtcattgatgaagagttcctcgtactcatccttctcctcgggggtgaggtcgacgtataccacgccgcggtccaggaattttgtctccacttcgacggacctgtaatccacgaggaatccgtcgctgacggcctgggcgagctcgtagccgtatgtgggtatgcccttctccaggttgaacacttcataggtgttcttgtcgatatcgtccttgggggtggccgtcagaccgaccaggagtccgtcgaagtaatcgaatatctcccggtacttgttgtatatgctgcgatgggcctcgtccacgattatgaggtcgaaatgcccgttggagaatgtgcgggtgttgtccttctcccttacgtcatcgataaggtttatcattgtctgataggtggaaagcacacacctggcatgcgtatcgcagttgttcttgcacaggttggtggtcgacagggacgggaggagtttggtgaaattgtccgccgcctgggagacgaggctcgtacggtcggccaggaaaaggacgttgcggacccaccccttgcggagcatgacgtcgacgagggatatgatggtacgggtcttcccgctaccggtggccatcaccagcagggccttcctctgtttcttctcaaaggcggagcataccgcctttatggcccctttctggtaatatctgtcgcttatgccgtcttttatggtggcatccgagaggttcttctcgcggttggcggagaggttgaacagtttctccaggtcgcgtttgcaatagataccccataccttgcgttcctgatagttgcggtcgtcgaggatacgtgtctcgaaaccgttggtgaggaagatgacaggtctcttgtggaacttcttctccagcaggtctgcgtataatttcgcctggtgtcttcctgcggaagggtccttggacgtacgtttcgcctccacgaccgccagggggtatccgtcgtccttgaagagcacatagtctgcgtaacccacattggagacgttgggcatgccctccagttcatactcgtcgatccaatcgtggttctcgacccatcctgcatcgcggagtttctcatcgatgtatctcttacgggtctcgaattcggagatctcctcctcggagagttcgcagtcctgtgtttcagacattttactgggcggcatatcggtttacgtagatattaaaccgaacgatggaaatccatggacattctggaaaacggcaggatgatcgggttcgacggtctctacaaatttcgatttgatgagcatatcgaagtactcgtccaccgcctccatgggggatccagaaccttttatggccatatccatccctcactggagcatttcctcgagtttcttcagttcttccgacagttcttcggcgagtctcctcatctccttcactatctcggaagacgggggatagctctcctcctgatagaccgtctgcttgtacttgtttatggagaggtcgtagtcgttaccggctatctcatccttggggacgaggaaagacctgtcggtcctcttcctgtccttctcaccctcgaggttcctgaatctggctattatgtcgggtatgtcgttctcctctatagcagaacgtttgtcgtccagggagaacccgtccgcctgcatgtcgtagaaccatacgttatccgttccaccgtgccccgtcttggtgaatattatgatggcggtcgatacgcccgcatacggtttgaacactccgctgggcatggagatgaccgcttccaggcggttgtcttccaccaatgccgtgcgcagggatttatgggccttggatgaaccgaacaggactccgtcgggtacgatggccgcacagcggcccccaaccctgaggatcctgatgaaaagtgccaggaaaaggagttccgtcttcttggtcttcacctgggataggagggacggggacacgatgtcgtcgtccagacttcccttgaacgggggattggccaagaccaaggaatacttctcggcgtcctcgttctgttccgaaaggctgtccttgtattcgatgtgggggtcctccaccccatggaccatcatgttcatggccccgatacgaagcatggtcctgtccatgtcgtagcccgtgaacatggatctgttgaagtggtccttcctgtccttgtcgaagaatatctccttcgacctgttctccttcagatagtcgctcgcggctaccaggaaaccagccgtaccgcatgccgggtcgcatatggtctcgtcggccttgggatccatgagttccaccatcatgcggatgatgtgtctgggtgtcctgaactgtccgttggtgccggcggtcgacaacttggaaagcagatattcatagatgtccccgcggacatccttttcactgaggccgtccatggactcgtagagttcatcaagcgcatccactatctgggagaacttctggggtgtgggtatcttgaatatggcgtcgcccatgtacttggaatacgcactgtccttgttgtcgtggatctgtttgatgaacgggaaaacgccgtattggacggtctcgaacatcttttccgcaggaaggtctctgaagtacgaccatttgaactgcttcccttccaccgtgccgttccccattttgtattccccgtcgaaaatgctcttgaaggggatcccgagcatgatggattccttggaatgggtgttgtcgaggtcgtcgaggtcccttatgaacatcagataggttatctgctctatgacgtccagaggatttgtcagaccgccggtccagaatatctcccataacccatccactttgcttttaagttcaccggtgatcatatgacctcttgcctcttggaacaaaaccgcaatgcctggacagttaaaataggtgtctgtttccgttttatcgtctgtatggcaccctcggagggttgggaagttgtttccgaaaacatatcaataaaacatccgaaaatatatcaatcatcatgtacctctgacgatgtggcacaatcatgacatcttctacggagaggtatcgccccaggctcgtggaccggagattggaggatgtcctgcgcatatgcggtgcagtcaatctcaaaggacccagatggtgcgggaagacatggtccgccagaaatctgtgcaacagcgccgtatgcctcgacggtcccggaggggacgatcggaacagaagtctggctctgatggatccctcgctggtgctcgaaggcgattcccctcggctgatcgacgagtggcaggaggtcccctccatctgggatgccgtccgtcaaagggtggatgacgatgtccggaaagggcttttcatcctcgccggttcgtcggtcccggacagaggggatttcatccattcgggcgtaggccgtatgatggacatccgtatggatacgatgactttgtccgagagaggtctttccgacgggaaggtctccctaaggggattgttcgacctgcccgacatatctgtgcgtaccaggggtccggattatcgcgacctcgtagacatgaccgtccatggggggtggcccgccgctctgtccttggatgccgacggatcgatggaacttgccggaaggtatctcgaagagctggtctccgaccacatacatttggatgggaccgtccgcaacggtgtgaagatgcggcggctgatgcattctttggcgctcagcgagagcagggtcgtttcgaagaaggccctgtatcgtatcgcctcggaaggtggcaccatggcatacaacacgttcgacggatatctcgatgtattggtgaggtcgtacatcgtggagtggcagcccgctttcgacccgggtatgcgttcttatgtaagggtcggtaagatgcccaaactacatttgtcggacccttcgctcgccgccgtcgccttagggaccgaccttcggtcgtattatcgggatcccgtatcgttcggaccgctcttcgaatccctctgcgaacacgacctccggatatacgccgatacattcggaggcagactgtatcattaccgtgacggcgacggaaaggagatcgacgccatagttgaactcccggacggacgctggggcgccttcgagataaaactgggggccaacgagatagagaagggtgcgaaatccctcctggacatcgaccggaagatccgcaaccaggagaacgggaggcctccggagttcctgtgcgtcgtatgcggcctcacagattacgcatacaggcgtccggacggtgtttatgtggtccccataacctccctgagggagtgatcccgggggtcatccgcagtacacggagcacacatggtccaggctggccgtcagccagccgtacagatagtccgcatgcgactcccaggtcctcagatggacgaactccaccggattggcccatatcgtggaccccagaacgccccaccggtcgaagttgtgttcgaagtcgtacctgtgggatctcaagtactccatgtccgcatccatggtgtccacgatggtctgacggttgagcgagaggaggtcgcccaccatctccgcgaacccgtcggtgcgcaggaggcctgcataccacttgttcatgtacgaggcgtagaggcattccgggtcagccgcctcgctcctgctgttgccggagctggtgtcgaagtcccagacgggtccgctgtgtatcagtccgtcggccgggtcgtaatacatgtagaagctggaccacgctatgtcctccgtgttgaacagttcgttcacgatgtaggtgagtgcgaagctctccacgtcgatgcacccctccatccgggctacgtcccccgacgccaccgcatcgtatgcttccctcacgcgcccctctatgaacgagaaatgctccgcggtccacagggggtccgtgacatccgggtcctttatcgcatagcagttcccgtccaagacgaagtagtccgtctcctccgtgccctctccagagatccatccgtccatctccacgatgtatccgctgtctgccgggtcctccgtgatgtaagggatgtctacgctggcactttcgatgcctatcctgttgcacaccatgtagacgccctggtagatcccgttgaggtacaggtcgacgaacaggcaggacggtgtgtgctccagccctatggagtctgctatcgtgtatgcgaagtaatccctggaaagactctggtcggcgtagttggctatgaatatgtaggtgtcggtaggtccgaatccgaagaggtccgtctcctcggccagcttgagcttgtacggtttcttcggcatgtcccaccatgtgtggttcccgtaccaggtggtgttacccctgccgcgtatcttcccttcggcaccggagatgtctccggccccgtcttcgtatcccgctacgtccacggagcataccagatagtcggtgtcggagagcacggccttcccgccctccgtgtcgatgctgaccacggggagggtgaggtcgccgtcggattcgctctcgttcgcatcgatgaggaatacggtcgccgccaggaggatgacggtcgcggcggccatctggtagttcttcacggcgtctccctcacaatgtcgccatgtcgtccctgatgtcggagacggagacctccaggttcccgttgcggcagcgtatcttatcgatcatgtccttctgttttaccgggtcccgggggacgatgtcgtaggtgaggcggaacatgcttcccatgttggtcgtcttcacccgggtgagtctgaacgaggaggtgtattcctccagtatgtcgtcgaactccttggagaagtccaggtcctcggggatcgagatgttgaggacctgatgttcccgcctgtcctttgtccttccgaggtcgaggcggttgtagacgacgtatgcggtacccatgatcaaggtgaagagtacggcataccccacgtaccccactccgttgagcaggcctgcacccatggccatgaatatggccccgatctccttggcggtacccggtatcgaacggaacctcaccaggctgaacgccccggccacggcgataccggtcccgatgttgtcgcttacggtgaggatgactatcgagactatggcaggtacaagggccaacgttatgacgaatccctgcgagtattcgttgcggtaggtgtagaaggcggttatgaggagacccacgaggagcccgcatatgacgaggagcaggaactgcgtcgccgtgaactcgttgatgtaaggactgttgaagatgttgtcgaatatggcgttcatcctatcgatcccggaatttccgtccgcagggtctcagggcccttggatgtttaagcaattgtggagggtccaatgcatcgatgtatttcaaactatcacattgttgtattggtcaacaatctccacatacatgtgccagatgtgcattttttcatcggtatccggtcaggggaagatataatacccccaggcaggagaagatgctgttgaggaatatgcagccgagcagcatccccacggccatcttcctctcccctccgacggcggtgatcgatgccagtatgatctcgcccagggacaccgtgagccctttgaatacgacttccgtcagccgtccggcatgggatgcggatatgctgtcgtatgcaccgtcgatcatcccgagcagtccgtcgctcatcagttcgaaccctattccgtacgccgccattccaattatgaatgcggcgagtgccagtgtaagaccttttcctgtaacgccatgtgtatcaggcctcgggaggaccgtcctctcgtccgacctcctcatcaggtacacggcgaaaagaagtacctgtaccgcggccaccaaggccagggattctgcgaatccgatgtacgacagcagtcccgcaagcggaaggcatacggccgcaaggccgatgaccacgacgtgtctgcggatatcggatccgtcgccgtccgtaagtcttgcgaataccatgagggtgatcccgaggaacaccagacctatgccgttcccgaccactatatccgtcatctcggccctgtcggatgtcaccaggactttgaagacctccggcagtacggtcgctaccgccaggacggagatcccgaatacataatgttccagacctgtcctgtcggccaccctcttggaacttcctaccaataagaatgcgctcgcagcgataagggcaaggcctacagcagttccgatgagccaggacatcagttacgcctcctccgtccgcggaatgtacggatgtcccatgaccagggccttgtatgcgttcccgtatttggagaaggattccttatggataccggatgcgctcatcgcatccacgagccacataggtatggcccccttgatcttcagctccatgagtgtgtatccctcgggtaggaggcgggtccccgacggaggtcccgacaggtccataccgtcgaggcgggccgttatgtcggtatccagggtgagtctgaatccgtcaccgtccgtggatgcgtacgcctccctccgatatgccagatacatcatcggcctcagattcccgtagcgccctatggtgtattccagctcgtcctttatctgcgaatgcatatcgggcgcatggccgccggcgatccaatccatggcttccgtacaaggcagggccatcctgcgcttgtacacgatcccgtcgtacttcttcttcaattccaggaagacggtgtcttccccgctcgcagggccgtagctcctgaccctgaccttctctttgtagacgggcttctctatggagcggcgggctagtatccatgacggggtgtcgcagtacaggttgcgtatctccgagaggccgtatctgtcgagggccatgcggccttccatggcttcccttacggcggacatcctgtcgggaggcaggacgtatttcatctccacccgtttgaagacttcctggtaggccatggcaacaccgatgatttgtcaatcggtaaccccgacctccgatttaaaacatctgggtcttccgaaccgtaggaaaatatgtgccggcggttccccgccggcggatgttttcagatcttctccagtctctggagcatcttgacgacggcgtcgatggcgtcgcgtcccttctcgatcctgtcgacggcctgcagctcggtcatgtcgggtccggtgactccgagggccacgggtttgtcgtagtcgagggcgaggtcggttatcttacgtgcggcctgtgccatgatgacctcgtcgtgtttggtctcccctttgatcaccgctccgagggtgatgaccgcgtcgatgtcgtcgcactcgaggagcttcttgatggccagaggcatgtcgaataccccgggcaccttgatgaccttggtgatctcgacgccgaggaactcggcctctgcctttgccctctccatcatgagcatggtaacttcgtagttgaattccgccacaacggctccgatcttgtatgctttcattccaaatcctcctttattgcttgtatacaggacctttgtcctcgaatccctgcctgagtccggtgccggccctctgggtcagcctctcgggcctgaacagcaggtcgtaaacgtttaccgcgtgctccctcgcacgcctgtcggccagccatgccagttccgaatcgctcttggcctcgtcctcgtggacgaacacctcgatgatatgcgtgttggtcatgagctgtgcccttatgaggccgttggaggcctcgtccgcacacatcttgtccttgggcatgggccccggcatgccgagggccatgcagatgtcgcagtgctgctcctcgatgagttttttgcaggctacgggcaggtccttcatcccgggcaccgtgaccctgatgatcctgaaccccgtcccggtcctctccagctcgtcgatggccgccttccccatgtcgtatctcgcgaacgtggtgtccgcgatccctataagtttcaagacgttccccccattctccttatcttctcgactatgcgcctggtggcgttgaggtcgtcggccgtctcggtggcccttacgaccctgatgtcgccgaggccgttgtccttcaggtccttcttcagtttcccctcgtcgaaatgctggtcgaacccgaggacaatcacgtccggtccgatctccctcaccacgtcgaagatgctgccggtgctgtggccgatgatggccctgtccacgggtttcagggcctccacgatcttcgcacgcatgtagtcgggggtgatgggctcgtgcttctccctgcgaacggtgtcgtcgctggccacgaccaccaccagctcgtccccgtaggacttcgcctgggacagataggatatgtgtccggggtggattatgtcgaagacgccggaggccatcaccctggtcatgtatcacacgtccagttcggggtgctgcttcttgaagtcgttccaggcggagatcacctcttcgccggtgacgaagggtatgcctttcttctccgcataggcgatgcagtcctccttcttctcggagtgcccgtcgtcgcccatcatctcgcagatggtggcgctgggaaggacccccgccatgtacatcatggcgctggcgagttccgtgtgtccgtgcctgttgctgagtatgtgttcggacgagttcagcaggtggacgtgtccgggggcgcggaagtaggtccccaggtccttggcgatctcgtcggcgggtttgtcctggaagatggtcttcgcatactcgctgatggtcagtgccctgtcgcagtcgggtatcccggtgtaggtgtccctgtggttgatggttatcccgaacgaggacttcgtgttatcatagggtatgtccgtgggcgccatgagtccgaggacggggtacttctcgcgggcgtcccagaagacgtcggacaggtacgggaggccgatggccttggcgagcctgtagggggtggtcgtgcagaggagtcctcccgcatcctgcctcatctgcctgatgatgtcgtgggtgacgaactgggaggcgacggtcatgtcgctctccttctccctgtcatcgaaatcgtagatgaggatgacctggcctttgcggatggcgtcaagcgctttttcgatgctcatatgttctccctcttatgaggtccgataagtccgagtataaaataagaagtgggtaattaccattatcttggtaatgtcgtgcatgtcctccccatcctgcggggcttatataatgaggacgagattacgctgtcatgtccaaagaggatgccgattacatcaggaaccaggttatggagcacaacagctggttcaacgactgcatacctatgatcgcctcggagaacctcatgtccccgctggccaaggagatgctcatctccgatttcgccgacaggtatgccgagggactcataggcaagcgctactaccagggtaacatctacgtagacaaggtggagcagagggccgtggacctcgccaagaagatcttcgagtgcgacttcgccgacgtgaggcccatatccgggaccgtcgccaacatggccgtgctcttcgcctacgcccagcccggcgacacgatcaccacctgcgccctcgaccagggggcccacatctccacctgcgagttcggggcattcggacagaggggggtcaaatccgtcaactacccgtggaagctcgacaacatgaacctcgacgtggacggcaccgcgaagctcctcagggaggtgaagcccaaggtcgcccagttcggtctctccgtattcctgttccctccgcccctcaaggagctcgaggacacgttcaacgaggtcggatgcctcgtctgggaggactgcgcccacgtcctgggtcttatcgcaggagggcagttccagaagcccttcgaggacggtgtcgacatcgtctccgcatccacccataagaccttccccggaccgaaccacggtatagtcctcgggaacggtctctccgaggagaacaccaagaagatccagcatgcgatcttccctggggtcacatcctcccaccacctgcatgcgatggccgccctcgccgttacgctcgccgagatggacgtgttcggcaaggactacgccgcccaggcctgcaagaacgcccgcgccctgggacaggccctctacgagaggggcgtgcccgtcctctgcgagaatcttggtttcaccaggtcccacgccatcgccctcgacgtgaccgagttcggcaaggggaaggcatgcgccaagctcctcgaggatgccaacatcatctgcaacaagaacatgctgccgtccgacaccagttccgtcaacccctccggtctcaggctcgggacccaggagatgacccgtctgggtatgaaggagaacgagatggacgaggtggccgacttcatagcgagggtcgtcgtgaagaaggaggaccccgcgaaggtgaagaaggaagtgaccgagttcaagcacggcttcgacacgatccagtactgcttcaacgccggggagccggcctacgagtaccgcaagctcgtaccctgaatacaaggcggtccgggccgtcatcggcccggccgtaccctatgcggatctggcacttctcgcaggggcatccccctgcatacatccgcagtccatcccatggaggtcttggaaatggggcggtccgaatccgaaaggaaaggatacatcaatctcgtccggatattgagatatatgacggggaaggacgtggcctacctcgtcctctgcgtattgctcatcgccgcacaggtctatctcgacctgcgcatccccgattacatgagcgccatcaccacggagatcgagatggtcggaggctccttcgacaacgtggtggacgacggttacggaatgatattctgcgcccttgggagtctcgcatcgtcgatagcgacgggtttcatcgccgccggtctggcgtccacactctgcaagcgcatccgcgccaaggagttcgagaacgtcgaaaggttctccgaaggggatatgaaccggttctccaccgcgagcctcataacccgttccaccaacgacatcacccagatccaactgttcgtcgccatgggtctccagatcatagtgaaggcccccatcatggccgtatgggccgtactgaagatcgccggcaagagctggcagtggagcgcgatcaccgtggccgccgtcgtggctatgctggtcatcgtggcctgcgtcatgtacttcgccatcccccgtttcaagaggatccagtggatgaccgacgatgtgaaccgtgtcgtcagggagaacctgaacggcgtgagggtcgtacgcgcctacaatgcggaaggctatcaggaggacaagttcgggaaggtcaacgggagcctgaccgagaacaacctgtccgcctaccattcgctggcgttcatgatgccgtccatctcgtcgatcatgagcttcctgacccttgggatctactgggtcggggccctcctcatagacgcctccggcacgtactccgggaagctgggtcttttctccgacatggtcgtgttctcctcgtatgccatgcaggtcgtgatggccttcatcatgatggtcatcgtgttcatgatgctgccgcgtgccaccgtggccgccggccgcatactggaggtcatcgatgccgaacctacggtggaggacggcgtttccgaaggtccttccgatacgaagggcgaggtggagttcagggacgttagtttcagatacgcggagggctcagacgacgtcctcagcggcatatcgttcaaggcctccaagggggagacggtcgcaatcatagggtccaccggatgcgggaagagcaccctggtcaacctgatacccagattctacgacgtcagcggaggtcaggtcctggtcgacggtatagacgtccgcgagtacaggaaggatgctttgcgttccaagatagggtacgtgtcccagaagagcatcctcttcagcggtaccgtggccgacaacgtccgtttcggcaggtcatcggaatccaagtccgacgacgacgtcaggaaggccctggacgtggcccaggccaccgagttcgtctcccggatggaaggcggtatcgaagcccacatcgcacagggcgggaccaacatatccggaggacagaagcagcgtctctccatagcccgtgccgtgtgcatggacccggagatctatatcttcgacgactccttctccgccctggattataagaccgaccgtaccctcaggagggccctgagggacgtgtcgggcgatgcgaccgtgttcatagtcgcccagaggataggcaccatacgcgacgccgacacgataatagtcctggacgacgggcgcatagcggggatggggacccatgaggaactcatatcgtcctgcgacacgtatcgtgagatcgcaaggtcccagctttcggaggaggaactccaatgagcgatgggaagagcggttccgcattcgggaccacctggaagaggatcatcgtatatctcgggaagggcaggaggatcctctgggcctcgctcatcctgtcgttcatgagcaccatactgacgctcatcggtcccggaaagctgacggagataaccgacaagatctccgagggcctgggcggtgcgatggacatcgacggcatagccggtctggtcatcgttctcgtcgccatctacaccgcaggtctggtcctgtccgtcatagagaactacatggtagccacattgtcccagaggaccgccggaaggctccgtgaggacctgtcctcgaagatcaaccgcatccccctcagttatttcgacagcaccagtacgggggatacgctgagccgcgtgaccaacgatgccgacagggtcggggagtccaccgacgagggtctggggacgttcatcagcgagatcaccctgctcatcggggccctggtcatgatggtctacaccaacatcacgatggccatggccgccatcctgcccacggtggccgggatgctgatgatgctgctgataatgaggaagtcccagaagtatttccagaatcagcagaggaatctcggggacatgaacgggctggtggaggagacctattccggccacaccgtgatcaaggcgtacaacgccgagggcaggttcgggaagaggttcgtgaccgtcaacgaagacctctgtcgcagcgccttcgcctcccagtttctgtccgggatgatgatgcccctgatgagtttcatcggcaatttcggatatgtcatggtctgcatagtgggtgcgctcctggcgctcgacgggcagatctccatcggggtcatcgtcgcgttcatgatctatgtacgcctgttcacccagcccctctccggtatggcccaggcgttcaccagcatgcagacagcggccgccgccggggagagggtgttcgagttcctggacctcccggagatggtgaaggatgagaccgaacccttcgactcctccaaggtgaaaggggaggtcgagttcagagacgtccacttcggatatgtgccaggcaaggagatcatccacggtttctccctcaaggtgaagcctgggcagaaggtggccatcgtaggacccacgggtgcggggaagaccaccatggtcaacctgctcatgagattctacgaggtgaacagcggggacatactgatcgacggaaggtccatcaaggacatgtcccgcgaggaggtccacgactgcttcagcatggtcctccaagatacctggctcttcgcaggcacggtccgcgagaacgtggtgtattccaaggaaggggtcaccgacgaggagctgacggacgcctgcgaggcggtcggactccatcactacgtggagaccctgccggacaagtacgacaccgtactggacgacgtctcgtccatatcggtaggacagaggcagcagataacgatcgccagggccatcgtccagaacgctcccctgctgatccttgacgaggccacgagctccatcgatacgcgtaccgagaggaagatccaggaggccatggacaggatgatggagaaccgtacgtccttcgtcatcgcccaccgcctgtccaccatcaggaacgccgacgtgatcctgatgatgaaggacgggaatgtgatcgagcagggcagccacgaggagctgatgagggcgggaggagcctactgcgaactctacaacagtcagttcgataactgaggttccgaaaggaaccccttgctgcggttgtagatatccaccgcgggctggatggtcatccatccgtccgcgatggtgataggcttcaggtccatgatcttgcacaggtcgtcgaactccctgtcgaactcctccctgtcgggttccaggcccgtgtccatcttgaccatgttcttgtaaccgcagatgtcgaacatccacttgatgtaactgtcgtcatcgtggatccccatggcctccagcatctccttgtccatgctggctatgaccttggcggaatcccctgcggccatgaagggtctccagttgtgggctatggccggtatcacatagaacatgccggtataggtcttctccagttcgagatatctggcacctcctcccacggagaccccgacgcagtcgtcgcagatccttccggtgttgtcgcggaacatctccacgggcttcagaccgttctccctcgcccactcggacatatcccatccgtagttcccgcacagtccgtagtacagccctatggcgtcgacgaacgggttcatctcgcgtacttcgttctctatgaaatccttcagatccttgggttccgaatgaagtgccagatcgttcatctttatgagtatggaatacccttccatatcgatggccctgttgaagacctcgttgtcggtgaccatcctgaaggatatccccttcctctccatcttctccttcatgcttccgcagtgcttgttctcgatgaggaatatgttcttctcctcgggatcgttggttatcccgtagaggagttcgtcttcgagcatgggacaggcgattatcccgaggatgcctttggtcatagtcatgctataattttgatagtatatacatatgatgtactggaggatgtttttcagaacgtctggatgcataattaggtgcacctaacctttaataggttgatgcctatacgcagtccgatgacaacgggaaatcgtgaagattatcttctcgcaatcctcaaacttaccgagggcggcaccgtggccaagaccaccgaactcgcgactttcatgggagtgtcccccgccagcgtcagcgagatgctcaagatcctttccaaagacgggcttgtggagtacgccaaatacagaggggtcaagctcacggaatcaggcctcagggaggcaaggctgaccaggaagaggcatcatgttgtggagaggttcttcacggacatcctcgagatggaccacgaacaggcccacgaggaggcttccaggatagagcattccatatcggacgcatccgccgtaaggatgtgcaacatgctcggcaatcctccggactgcgattgccagtgctgtgtggagccctgcaagagcgtatccgccaacggtatcgccataaccatcctgttgtccgacatgcgtcccggagactgcggaaaggtctcccatctcagatccgacgacagttcggtcctcaagaagctgctttccatgggattcgtccccggaaggaacatcagtctcgacagttccgacggcggcgcaagcgtcgtgaaggtcggggagtgctccgtggccatagacgattccatggccgcatcggtctatatcgacgtctgcagcaccatctgaaacgcgggcatccccgcttccatttttctatttcaaacggaaatgaaaagatgtcggaacggatgccgggaaggcatccgttcccgtctcagtcgtgggtgtagactgcgacgatcttctgaggatccttcttctcgatcctcacgaatccgaacctttcgaactgtacggtatcggccttctcttcgagtatggagtcctccacgagtccggaggcgacggtgccgtcggtcatgaggacgtcgcaggggatgctcttccttccgacccactgtacggccttgagtcctcccttcctcatgtcggagacgtcgttgcctgcatatctggcgggcatggagtattccaggttgcagaggtccttgagcctgatcctcctgtcctgggagaaggtcttggagtccttctcggagatgaagacggtcttggggccgtccaccacatactctttcgagcccctctcggggtggtcgggatgcaggggggcgttgccggttatggagtctatgccctctatgtcatacctcaccgggtcctggacgaagaagtatctgtcgcttacggggtctatgatgtccctgttcatgccgtacaggttgtcccaggagaaggtgatgtcgacggatttgataccgctctccacccagtacctcctgatggcctcgggtctgatgccccttctctcgagggccctgacggtcccggtcctcacgtcgtcccatccggtgtactggccttcctttatgctctgtttgatgagggaggtcttcagcatggtatcggggatgttgaccagtccgtagtggtggtagaccggctgcttccatccgaagtagtcgaagacgtacctctgcctctcggtgttgttgaggtggtccttacccctgatcacatgggtcatgcccatgaggtggtcgtcgatggcgacggacaggttcatcatggggtacacgcggtacttggtcccggtgcgggggtgcggcgcatccacgatcctgagggcgacgaagtcccttatggcagggttggggtgagcgatgtccgtcttgacgacggcgatggccttcccctcctcgtatccgccctccatcatcctgtcgtacctctccatctgttcgttgactgggaggtccctgcaggggcaggcctgcttctgctccttcatgctcctccatttatcggggtcgcaggtgcagacgtaggcgtgtccctgttcgatgagcttcctggtgaggtcgtagtatgtctcgaacctctccgattggatgaacttctggtgtatcttgactccgagccaatcgaggtcttcggggatcatatcgtaggcttcgggatctatcttctcggggttggtgtcctcgaacctgaggatgagcttcccctcgtacctcttggtgtattcgtcgttgaggacggatacgcgggtatggccgatatggaggggtccggaagggccgggggcgatcctcatgacggtcttcccctgctccacgtcctcgaggtcggggagctcgtagacgcgctccttcttctccttcttgagcatggaggggtcggccttctccagctccgccttctgggcgtcgaagcccatggcgttgacgtcctcgacgatgccgtttatggtctcggtgatctcggcgaccttcgccctgtattccggatactgtccgagtatcttgcctacgatggccttggggttggccttacctttgaagaacaccgcgttctgcagtgcgagtttcctgatgatgtcctctatgggctctgacatgatggtttgctccattcccgcgcgcctataatagggttacgaggtgcctgcggtacggaggtaccgtcctcctgcggcctttatcctctcggggtctccgccgtaccattcgcggaaggtcgtcccttccgattgtacggcctttccgatcgcttcgaagaacgcaggtacctcggactccttgacgcttccgacgacatcgccgatcctctcctttccgcggacatgggaaccgttgacgctgacgacgaaggacgcctccccctcgatggcgggccctccgcggagcccaacggtccccagctggtgggccgcacaggacgagacgcatccggatatccttatcatcgggaggacgccgtccgcgaatccgttccccctttccatggagatcagcctgtccaggagtccgcgggaatcgcggagtcctatctggcatatggtgctgcccacgcatgacacggacgattcgaagacggtgcgggcaccgtccgacgtgacctcggccatcatgtccgcctcggagccggtgaggttcacgaagtacatcgtctcgttcggaccgatacggatctccgcatccggtatgtccttgatcgcatcgtagatctccaggaccttctccggtgcggggtcccctccgatcggatggtatacgaggtagaacagcccctcctgtatctgcggacgggccctggtggtaccgggtacggtgccgtcccccttcttggagacggtcctgggggcgggatgcaccttggggacgtccccgcaggacacggtctttccgacctcttcgttgaatctggcaatgtatccgtcgtcaccgagggaatcgcgcatgtagcggacccttgcgtggcttctgttctcatagtccccgcaggcgatgaacatgtccaccatggcggcgagatagaaacatacgtcctcgggctccgcatcctcgcggaccagaagacccagacgcggattgttgcccaggcctccgccgctgtatacgtcgaacttcccgttttccttggcgacgaaccccaggtccctggcggtggcatccgtcatattctcggcggtgttggagaatccgaccttgagcttcctgggaagtttcttgccgaccgtgtagtcgaggaggaacctgccggcgcattccgcataaggctgtacatcgaacggggtcctgatgacccccgagaggggtgtggccgtgacgttccggggatagtctccacctcccccgtaggtgaggatgtcgtggtctatcgccccgtccactatcttgggtatggagggtcctgcgagaccgtgcagctgtacggactggcatgttgtcatgtggaccatcttggggttgtatctccttatgcagtcgcatatgaaacccagcttgtccttggtgatgacccctccggagaggcggaacctgaccatcccttccttcccgcctctctgggcatagcttccgaatcctccggatatgcccttgtattctttgacggacatctcgcccgagtagaacttctccgtagcgtcgttgaatctgggcaggatcgccctgtattccttgccgtccatgttatcgggtatagtctgcgttctgtatatttacccgttttctaaacgatggttttcttttcgtccttgcctggatcgtgcgacgcggatccacgggttttcacatcgtttcccggatgcatgcatgtcgtacattggacgttcccggacggatacgggtgcatcccgaatcatgcccagatatcagttctggcacattgaaaaagaaggtccccgtcccgggggatatacggacggggtaagatgtttcgtgaaaacggtttagcgttatgttcactggccctttccggacctcaggtcctccctgctcttcctctggaattcgcggagggactccttctcggccttgagctccaatctcttggcctccagttctttctccccttcctcgtcgagccttccgatcctcttgttgtcggtgagggtcttgacctcggcgttcagggcggctatcctgtcctgtctgacggcgacctcggagtagcattcctgcttgtacttcgcgacctcctcgggggtggcggggaccgccctgacgggcatctccccgcctatgcgctccgcatccgcaggtgccgcaccgcatgcggccgggacggccatgttgcttccgtcggggttgagtccgtgcctcctggtgaggaatccgggacccttccagctccagtctcccatcaggtgcatgagtgcggggctgacgtatccgaccatgagcagtccgtcgatgaggatacccatcccgagggcgaatccgagctccttcagcatggaggagttggcgagcaccagggtgaggaaggtgcctcccatcagcagggcgcacagggagatgaccggtccggcctccttgatggcgttgtcgatggcttcgtcgttgttcattcccttgatcttgttctcgcggatcttggtggtcatgaatatctcgtagtccattcccagtcccagcaggaccacgaacaggacgatcgggatcaggaatagcacaggcgtgtccatcaggccctcgaagaccacatgggtcagggctaccgtcaggaagacgctcagcaggatggtgatgatggacctgatcggggtgagatagcttccgaggatgaagaacagcaggacgatgagcaggatggccacgactatcctgatcatgctgaactggtcctctatgtccttggacatgtcgtcgatggaggcggaggttcctgcgacgtaggatgcgctccagatgttgcggtgtacgtaatcgtaggattcttccccgtcgtgcaggtcggacctgagttcggcgaggaagtccatggtgtccgcggacatcggcttgtccgtggtgatgaccatcacgctgacgtactgtccgtcgtcggagaggataccggtacctacgttgaggatcccgtcgatgatgttggccaccgtcagctcggatacgacatacgagttccagggcgcgtcgaatgcggtggggtcgatgtgggtcaggtcatgttgtccggatgcgatggcgagtatcatgccgacatagcccttgacggcgctgggcatctgttcgtagagggcctggttgatcgtggagggatcggtggtcctgaggtcggctccctctttcatgtacatgatctgccaggaattcagtccgctgatgcttccgactatctcgtagtcgtcgatgtcgttggtcatctccatgacggccgggacggccccagtcatggtcgccgggtccagcccgtgttcgttccatatgacgtaggggatgctcattccgccgtacgatagcgaacctacggtggcgatggattcgttcatctcgaggacgatgtaggtgggcatgatggtcccgccgtcggtctgggtcatgatgaggtccagaccgtccacggattcggagtcgggcatgacgctgatcatgtccgcggagtcctcggactcggcgaagatgtagagtccggggatgcagaggaccacgagggcgatggcgatcagcttggagtgtttgtgggtgttcctggagagccaggcgaagtatctcttggatcccttggacaggtgtccgtggactccgagcttgcctccgttctgcaccttgtcctccaccctcttgtaactctcgatgttggagggccagaagatcttgtccttcacgaggttgaggagcgaggggatgaaggtgagcgctgcgacgagtgctatggctattcctatcgcgaggattattcccatggtgcggaccatggcgaagtcgcagagggcgagtgcggcgaatccgatgatgacggatatgccggaggtgaagacggcctctcctccccacatgatggcggtcttgagggcatcctcgtgtgaaagtcccttcttgcgctcatccctgtatctggttatgatgaatatcgcatagtcgcatcctgcacccagcatcgatacgaggatcagggtctgagtgatgtagtagactcccatgaggcagccgatggcgtagactgcggcgagtgcgatcccgtatgccattccgacgaccgcaggggggaccaccgctgtgaccacggcgtagaagaacagtcccagaagtacgaagatcagaaggatggacagcgggtcgaccttggacacgtcctccatggaggagttctcggtgtcataggtgatcgcatcgtttccggtgacgtaggtggtaaggccggcggcctcgggataggcggcggacgcgttggacttggcctccttcacgaggtcccttatgttgtcggtctcgtgtgcgatgtcccagctttcgccctcgttgttggcgatggcgatcataaggatcccttcgacgttagggtctcccttggaatacgtaccgtagttggatacggtggtcttggcaccgtatttgtcatccatgaggttctggaactctacgaatatggcctgtgccgcggcgagttcctcggatgacgaataggagatcaccaggatctccgatagatcgatcgagttagagaagtgttcatcaattatcgcctgtccgtcggaagcctcggtgctcgaaccggacatgctgttcatgtcgtattcgaggacgtctccgcttttgattccgaacggcagggcgcatacaagaaccacgagccaaagcgcgattacggccttggagtgtttcatgatgacatctgccattttcgagaacatttgttcaccttgtaaaccgattctaatcacgatataaataggttttgaacttgctcaataatttatggacgaccgataaaaataatcgaacatgttcgtaaataatcgtgttttacgaacgtgtttaattcatgtggtgttaataatatatgattctgctcaaatgtatttgagcataatcaaatctaaatatcggagacgtattgtaaacaatgtaaacggagcagaatcggtcatgtccttcaacaacggtgcaccgaagacgatggaagagaggcgcgaggagtcccgcaggaagatcatggaagcggccatggacctgttctactatcagggctacaaggagaccaccacccgcgacatagtcaagagggccggcatcctcaacgggagcctctacaaccgcttcaagagcaaggaggagatcctcctcagcatcatatcggaggggctgggggatttcctgtcggaggccgagaagctgatcgccgaggacaaggaccccatggtggccttcgccttcccggtcgccatcgagctgtatctcgcgaaatcgtccagacgcatcgccgaactcctctattccgcccattgctcctgggaggcggtcaacgagtacgtggacctctacggggagtgggccaagaaggtcctcagcccccaccaccataacgtcctggatgacgagaggaacaggatgaaggtgatagcgatcatcggagccgtaggcaacgtatgcggatgctacgccaacgggttcaaggaggactacaaggtcgtactgacccagatgatcaagttggtcagcacggtcatagaactccccgtgttcgacgtgggttccctcgtctccaagctcacctccgtggtggaatccggcgacctggtggtctgcggccacaggatatccgcggacgacctccgctgtgcggaggagacggcggaccgttcggataaggattaattacgcgggcgcgattgtcttccaatgacaatcgatctcgaaggggcgaaagaggtcagggagaccatcgacccggacaactacgatgctacgcgctacatgcagggcgatcaggagacaacattccttttcagcgacctcaacggaggcagggccgcaggcaacgtctattccaccagggagaagatcgcgaaggccatgggtatcgagagggacggactggtcatgcacatcatggatgccatggcgtccccctgcgacacggaggaggtccaagacccggccttcggattccaggagcttcctctggaccttacgaaactccccatcgtgaagtacttcccgaaggatgccggcagatacatatcggccggggtcgtcatatcggagtacggcgggaggaggaacgcctcctaccacaggatgctgatcagagacaaggattccatagggatcaggctggttccgaggcatactttcaccctctacaacgaggccaggaagaacggggaggatctgaaggtcgccatatgcataggtgcccccgcagaggtcatggtatcggcggccctgtccgtcgatttcggcaccgacgagctcaccatcgcctcctccatgtacagaaaaggccacgggacccccctcaaggtggccaagtgcggcaacggcctcaccgtccctgcggattgcgagtatgtcctggaaggcaggataacctcggagaccgcccccgagggtccgttcgtggacatcgcagggacatatgacgagataagggagcagccaatagtcaagatagagaggatctgggccaagaaggaccccgtcttccagctcctcctgcccggaggattcgagcatttcctcctcatgggggtccccagggagcctatcatcttcaagaccgtgaggcaggcggtgccccgtgtgaagaacgtccgtctcacggaagggggctgctgttggctcaacggggtcgtctccatcgccaagaacaaggagggcgacggggtgaacgccatcatggccgccttcaccggacatacgtccatgaagagcgtcatagtcgtcgacgacgacatcgacatcttcgacgaccgtgaggtcgaatgggccgtggccaccaggatgcaggcggataagatcataaggatcccaggtgcggcgggatcatctttggacccttccgcacacgggactacctggaaggtcggttacgacgccaccctccccctgaactgcgacagggcccccttcgtgaaggccaccgtcccagagaagaaatgacctggaagggtcgggggaggtcccccgaccctgttttacggtctcacatgatggagatgtcgcttctcgacatcttctccctgtcggaaagcaactttccctccaggagttctttcactttcccgtccgcatcccctttgatgcccgagtacacggttatgcccatgctctccatcctgcgtgcaccggcggtgcataccgaaccgcttatcaccgcattgatggaatagggggcgaggacgtctatgacggcatcgtgtccgcgtgccggattctctatgatgcgggtgtcgacgacatccttgtcgtccgtttcgtacagtttgaatctgtccgagcttccgaagtggcgggatacctccccttcatcatagctgacggcgatcctcattgggaccctctgccgcaggtacaggatccttcgtggtggtcatggtggtggcatgtggtctccggatcgaaatccaatgtaccagatacgagcctttccacctgttcgtcggcattgccggagactcccgggtagacttcgatacccatgccgccgagcatctggcgggctccgccccctatgcctccgcataccagtttctctacccccatggatttcagataccctgcgagggccccgtgccccaggccgtcgttgccgacgacctcggatccgacgatcttcccgttcttgacttcatagatcttgaactgctccgtatggccgaagtgttggaagatctccccgttttcataagttgcagctatcttcatagcattctgtaatcacggccggaggatatactattaacgtatgtagtaggagaacggccgtcttcgaaggatccgtaatccctacatatctgggacatccccgatctcgatggtccccggaaactcaggatgttccgattccctccatgtgatgctccaggcaatacgtccgtccacgggatttattccgaaagcgtaagaagtttgaaaagaaggcccgaaggccttcaggatttgaagcagcttctcttgctggatatctggaagcagatgatgatcccgacgatgaagcagatgacgctcgcgatcgcgcagatggacgacaatacgcagcaccatatgcagacgttgtagtcggtcctgttcttcgccttgatggaggtgatgagggagaacagtccggagaggatgagtccgctcatcaggacgagcatatacattccagcctccatgtccgctacgaagaccatggatgtgagtcccagtccgatggcgattgccagaagtccccagagaagggtcagcatggccacggtgtcgaggcttccgtcgttcacgggaggggaataggtgccggaagtcccgcacccggtacctccgtaggcgctcccgtcgttaggggttccgcacttgggacagaacctgtcgctgggactgaggagtgttccgcacttgggacagtatgccatcagttccaccaatcctttctcctgtcgatcgtctggtccctgtcgggtccgatgctgacgatgtcgacgggagtcttcagttccttctcgatgaattcgatgtagtccttcatctccttcgggaggttgtcgtatcctcccttgacgacggactcggtgtcgtcccatcctttccaccctttcaattcggtgtagatgggtttcgccctctccaactgtttgatggatccggggaagtgtttggtcctcttgccgtctatctcgtactccgtgcacacagggagcacgtcgtagtcgttcagtacgtcgatcttggtgatggcgatgctgttgaatccgcagagcatgttggcgtggttgacgacgacgaggtcgagccatccgcacctccttcccctgccggtggtgacgccgaactccccgcccttcttctggagttccgcctcctcctctcctttcagttccgtaacgaacggaccctcgccgacacgggtggtgtaggccttcacgacacccatcacgccgccgagtctgttgggggcgatgccggccccggtgcagatgccgccggccatggtggcggaggaggtcacgaacggatacgtcccgtggtcgatgtcgagcattgctccctgggcgccttcgaaaagtacgttctttccctcgtccagggactcgttgatgaggacagaggtgtcgcagatgtatttgccgagcttcatcccccatccgttcatcttctccaggagggactccggggtgcagcagcactcctcggcgcccatcatggccatgaggtccttcttgtaagggaggagcatggatatcttctccttcagggtgtcctcctccaggaggtcgccggcacggaatccgatcctggcgatcttgtcctggtatgtcggtccgatccctttcttggtggtgccgacgggtttcttgccgcggtatttctcctccgcaccgtcgagtttcttgtgatagttcatgatgagggcggccctgtcggagatcctgagaccgtcaatactccctccggcctcttccacatgggcgatctcgtcgaggagttcctccatgttgaccacggtcccgtttccgatgacggcgagcttgcccggccttacgaccccggacggcaatccgtggagtttgaaaaccttgtctccgacgacgatggtgtgtccggcattgttgccgccttggaaacggacgatgagatccgccttctcgtcgagatagtcgatgatctttcctttaccttcgtctccccactgggacccgatgacagctaggctaggcatatgaaatcgtacgaccatcgccttcaaacatttataggtacgcgcacggctgggtcgggtcggtatccgacgatctccttctcgacgtgctcgatgacagacggatctatcctggatccgctgactatgtatgcgcagttgaggcggggattgacaagccccatgttcgtgacggaacctatctcggggtcgtcggagtgcctgcacatgacgtaccggacgaggagctgcaggaccttatccttcggcagcggttccgtggaagtcgtcatgtcccagacggtggatcccgtgaggtagttgccatatccttcggtgatcctcccgccgtatcctcccggcatgtcgaatcctatcctcgtgaccggacccatgttggcgaagaaccccaccgtcctcctgaccattatgcggatgttctcgcaggtgtggtcgttggcccttatgcgggaggggtgcgcatatcttccggccccgccgctggtaagggcgtaggctgccagtttgcaggcgttgtctacggaggcgtcgtcgaaatcccctccgtacctgcagtttatcccgtcctcgaaggcgtctatggacgatgccgtaccgtatgtgtcgagacttttgatgcggagacgttggaacgttatcctctccgcctccttcaactccatcagcttcctctcgtacatgtatccgttgcgttcgttgaggaataccagggtcgagaggagcgatacggcgctttccactatgtcccagcctatgttgtcctgtcccagatacctgccgtccctgaacgtcagggggacggggtcgaagatgcctgccggcacgaatccgttgggaggctgctcgatgcccgcggtcccctcttggatccctgcgatggagatccctcagtcgcgcggagtctcgttaccgttctcgcggtagatctccaggatgtctttcagaggcagctccgtaacgaaggaggtgggtgagaaatgggtcttggacgtaggccccacctcgttcatcttctcgatgaacacgtccatgttgggaggcgatagtttcgtgaaggacgacagctcgctcacgtcgtacacgaacggggtggaatctatctcgttcctccagatgtccagcatcttatcgcacttcttttgtttggccatgccctcggaggacatccttccgaggaggtccttgtcgaagaggggtccgagccagaacggacccagcctgtggtcgcggtcgtactcgtatacgcaatccctctccagggtcttctggtcgtaacgcatgtatccgagatgtgccagcatgtcgtcgcaggccttggtccccgggacgatctccacatacgtcctgtagtagtggtcggcgtagaacgacagcaggggacgcatgcccatgtcgaacttccccatctcgcgggctatgttgcacatgagtatcctgagccccccttcgtggcacatgtatccgcgtatgggctcgcattggtatctgcgcctgcatttgggggtctgagccccggcgaggggtgccgtatcggtggcggtgacggccaggacggcgcgcttgcggcatccgcgtatggcggactgtatgaaaagggacggcgacccgaacgggtccaagtccacgtagtcgtagctgttctcggcgaaaaggcagtgcatgtcggagtgggatgcacggcagttctccaggccgttgatctctatgttggcctcgatataaggtatggcgttctcgtcgaagtcgttggcggtgacgtccgtccccgggacctcgttggcgatcctgaccgccctcgacccggtggcggtcatggcatcggccacggtcatgctgggtctttgaagcgccctcagaagcatgacgctgacgtccctgttgaacgccatctgttcgttgaagaatacggacccggcgttgatcttcccgggaccatgggtggaatgcacctcggggaccaatatcctagtactcccctcggttattatgtttcctgacggcatcaaatgttttcaccgttcatcaggcgcatgatcttgtgcggaagaaggttcctgttggtgggggtgacctctaggatcctcacatcgtccctccttctgatgtcctgcaggagggggttcctggatttcttatggagcgtcaatatcatcggtttgtcgacatccaatgcgtccttcactgcatctacgaacgcctggctctcgacctccaccttgccgacctcgtcgatgactatgacgtcgcaggtctcgcaggcggtcttgatggcgtcgatggatatggactcaaaaagggacaggtccactccgagattccccacggtgatcttgctctcgacacccggtttggcaaaggtgaccttctctccggtctggaggttgcagacgtttatgccgatctcatgccttccgtcggttatcttctcgtctatcattccgccgaccgtaatgtcttttccgagcatctctataacgcgtttcaaggtgtaggtcttaccggagcccggaagtccagtaataccaatctttatttcgttcaccaagcgattgtccccctatctggatggtctttaaagtataaatattgatggagttctacgggactgggacgcccgattttgtatacatttgtacatcgattggatggttttactggatgtcttcgatgtacattagggggtatccgagctcggcatcgtacctcatgaccgctttcaccgaggcgccgcccaactccacgaccaccgtcgcatcgatcatgtcccctgtgagggacgtgtacgagtattggtcctccttgtcgccgcatcccctgcgtatcgaaacctccgcatcgcggacgtaaggttggacctttatgcattcggcgatggtcttctccaggtcgccgacgttcctctcgcagaagggggtaccgacgaactggtggtatatggtggccatctttatgccggcttcgaaacaggcacgttccctgtcgttgcatctgaacctcgaatccgcaagagtctccctgtcgccgggcatattatctgttacggctatggtaacaatgtttaaaaagcggatgtactacgccacggtaacatgcaatccgtagcgcagcagatagccgctctcaagaaacagaagaatgcgataatcctggcacataactacacacttcccgaggtgcaggacctcgcggacttcgtgggggattctctgagtctttcaaagaaggcggccgctaccgatgcggacatcatagtcttctgcggagtctccttcatgggggagaccgccaagatcctcagccccggaaagaaggtccttcttcccgaacccgaggccaaatgtgccatggcggccatgtgctccgccgagcagatcagacaggtcagggccaaatatcccgatgccgccgtcgtcggttatgtcaacactgcggcggagaccaagaccgaggtggattactgctgcacttcggccaacgccctgaacgtcgtgaacgccgtccccaacgaccagataatcttcgtccccgattcaaatcttggaagatatgtgagggagaagtccgggaaggacgtcatcctctggtccggattctgccccgtacaccagtgcgtcacccttaggcaggtacaggagctgcgggcggcccatcccgatgcggaggtcgtcgcacaccccgaatgcagactggaggtactggagatggccagtttcgtaggttccaccgaggccatcctcaactactgtatcgcatccgacaggaaggagttcatagtccttaccgagtggggtatgggacacaggctcgagaaggcatgtcctgggaagaagttctatttcaccaaccagtccctgtgcatgaccatgaagatgatcagtcccgagtccgtcctggaatgtctggagaaggagactggggagattgtcctggaccgcgatgtgcaggagaaggcatacgtcccggtcaagaggatgacggacatcctgggatgacccagacaccatcgttccgacaccattaaacggtcgatgccgattaacttccgagaccgtgccggatgaggataatgcgagctgatccgtgatgagccctatgagtgccgacggccgtctcactccctgtcgtcgtagttgctcattcccacatacgacagcagttcggacagcttcatcccgtcgttccatctcatgacgaagttcccgcccttgctcacatccagtttggggatcctttccttcaggagtgcggcccttccgcggagtctgctttcggacggcatggtgaatatcctccacgggtcccctctgacccctttgagtctgtaggcgtagatcgggattatgtggcagcggtcgcagtcctccatcatgcggttggcctgctcgaccagtctggcattcttgctcatatacagaacgtcgttctccgagctcttcacttcgatggggaatgagaagtcccatctgagggccacgaggtccactccgagggacccggccgcccttatgaccatgaaagggaagtccttcatggaaccgtaggcctgcgtttccgtctcgtcacaggtcttgaccattttggcgatcgctttctcgtctccggacaggaggtatttcagttcgcgttcgtaagtgtcgccgggggctgccatatgttaccgcagtggcgggaatggtataaaagcgaaagggggaggggtgaccgaatctgagcggaaacccctcctttttccgaatctgagatccggtgttcaaggcatcagtctgctgaggtccctcgggaagaggatggcctcgcggacgttgggcaggtcgagcatcttctcgaggagcctgtccacgccgatcccccatccgccgtggggaggcatgccgaacttgaaggcggccagatagtcttcgaagtcatcggggtccagacctttcttctgcatcctcgccacgagtacgtcgtacctgtgctccctctgtcctccggaggagatctcctgtcccttgtagtcgaggtcgaacgagaacgagtagggggtaccgtccttctccatgatgtagaaaggcttcgcctcttccgggtactcggcgatgaagtagagttccttgccctgtttcgccatgtactccccgacgatcttctctccgtcggtcccgaggtcgtcgccctctttgagcgggaggccggcgtcctgcacgatcttcaggcattcggagtatgtcaggatggggtaggggagttcgggcacgttgatgtccttgccgaggatctccagctgtttcctgcccttctccttgagacctctgaggacgtggtctacgacctttccgatcatctccatgacgtcctcctccttctcgatccagcacatctccccgtcgaaggaggtgaactcggtcacgtgcctgttggtgttggagtgctccgccctgaaggccgggccgatctcgtagatcctgtccatgccggtggacatgagcatctgcttgtagagctggggggattgtgccagatatgccggttttccgaagtagtccacgttgaacagggtggcgccgccctccgccccggaggccacgatcttgggggtggtgacgttgaggaagtcctcctgggacatggcctccttgatgaggtccaccatcatggacctgagttcgaagatggccctgacctcgggttttctgaggtccatgaacctgttgttgaggcgggtgtccatctccacgttgaccttgtcgatcacgccgagggggaggggtgtggccgccttgctgtagacctcgcaggcctcggggatgacctcgagacccagagcggtctgtttgctctccttgacctctccggtgaccgagacgacggactccctggggagcttcgtcatgagttcgaacagggagggttcgatcttcttcttgggaagggtgatctgcacggtgccgtacctgtccctcaggatgaggaacgagatgccgcccatgttcctgatgtcttggacccatcctttgacggtggccttgccgtccgccacggatatgttgcctgagtctctgactgttgccatattaacatccgcgtgtatgcaggtcatttattaaaggctcgctccggagcagagggccgtccttacaccccctcatcagatttaaaagaatgaagacgatgtgcccggacatgaagttcacgatcaccggcatcatgtcgcaggtcctcaacgtgcagttggcaccgggcgacattctgaagaccgcgccgggaaggctcataagcaagtccttcaacgtgaacgtcaagatcaacgacagcgccttcatatccggtctgaagaagatgttctccgactccttcatcgacatggtggagtattcctccgagaaagggatgggcctggtgaccgtggggccctccgtacccggcatgatcatggacgtggacctggggaagggcgattggatcatgcagaaacacggtatgctggcctgttccaggggcaccgccatatcccgtgagatgcagagacatctcggagacccccagttcgaccaggaggggctcgtcctcctcaaggtctcgggggacgggacggccttcatcgcatcgtgcggggacttcaccaccatggacctccgcccggacgaccgttacacggtgtccacgtcccatgccctggcatgggagagttccgtcaaatacagtataaggtccatcaggagcaaggcggaggacacccgggacgacgatgagtgcgtcaccgatttcaagggtcccggcaggatcgtcatacagaacatgagcgagggcgacattgccggcatggtcgccaggttctcggcgaagaatcagtaaggcggattccgcattttttcggggatatcggtcatttcggacatgcttcccgctttgtttcaaaggtaacttataataatataaagagcgtcggagcgcacaataacggtgaacccatggctgaaaaagtcactgtatcaatcatcaaagcagacatcggatcgatatgcggtcacatgaccccccatccctccatgatggccaaagcgaaagagatcctgaccgacaaacagaagcagggcattatcgaggacttctacgtcacccgcgtcggcgacgacatcaacctctacatgacccactacaagggcgagggcaacaaagaggtccacaccgccgcatgggagtgcttccaggaggccaccaagatctccaaatccatgcacctctacgccgccggacaggacatcctcaccgacgccttctccggaaacgtcaagggagcgggacccggttccgcggagatgaccttcgaggagaggccttccgagcccctcgtgttcttcatggccgacaagaccgagccttccgcatactcgcccatcctcaccaggatcttcctcgaccccttcaccaccaccggcctcgtcatcgacaagagggccaagatgggattcgacgtcgagatccaggatgtcatggaccacaaaaaggtcgtcatgtcctcccccgaggagaccctcagcatcctcagccttctgggagacacctccagatacgccatcaagaggatcaacagcagggcaggtctcggacccgcctgcgtcgtatccaccgacaagctcaacatgaccgccggaaggtacgtcggaaaggacgaccccgtctgcatctgcagggcacagagcggattcccctccgtcggagagtacacccaggtgttccagaacacctggctcgtcgccggatggatgaggggatcgcacatcggtgcgttctacccctgctcgcccgaggactccaaccccgtctactacgacggacctccgagaatatgcgccctcggattccagctctgcgagggacacctccagggactcgagccccagggagtgaagggcggagaccacatccccgtagacatcttcggaaacaacacctgggacaacgtccgcgccaacgccatcaaggcgagcaggctcatgagggcccagggaccgttccagccttctatcctcggagcagaggagatggagtacacctccaggcccgaggttctcgaggatctcaagaagaggttcgagccccttgactgaactgggaaaacacgtggtgatcgtcaacttcaaggcctaccgcgaggtggacggggccgcagccgtcgagctggcgaagaagtgccagcaggtctccgaggagaccggcgcctgcatagccgtctgtcctcccgtggtatctctggcggcggtcgccgcggccgtggacatccccgtcctctcgcagaacgtggatccccgcgcgcccggttccgccaccggatgggtgaccccgtccatggtaaggtcgtgcggcgccataggtactctgatcaaccactcggaacacaaggtggatgcggaggtcgtgggggaatgcgtcgagctttccctcggatgcgacctcaccaccgtcgtctgcgccgacaccgtggataccgccgtgtctctggcacgtttcacacccgacttcatagccgtagaacctcccgagttgatcggaggggacataagtgtgaccaccgccaacccgcgcatagtcgagagcacggtcgagtccgtcaaggacgttaacaaggccgtgcgcgtcctatgcggggccggggtgaagaccgggaaggacgtcgccgccgccatcgacctcggtgccgacggagtgcttctggcatccggagtcgtcaaggccaaggaccagtatgcggtgctcaccgatctggtaagcgccctttgatgggaccaatcaaaaagtcggtatatcagaatgtgtatcatccttcgggatgtacttgaaaaggaaggatataccgacaatattacttgcagttctggccgtagccgtagtaatatcccctacggtcatctgcggtgacgaagggtctgtgtcttctgcggacccttcattcacacctacatattatgaagcacaggtgactccgttcacctttcccgaaagcaaaggcacgcccatattgacggagctctccaaggccacttcgaccgtggatatctccatctattatatgggcagcgaagaggtcatcgccctcctctgcgatctggaggaatcagagaacgtcgacgtcagggtcctcgtatcggggaatcctctgggagtgaagaccgacaacgagatgtccatgctcaagcagctggaatcggtcggcggagaggtcaacatcatcaactatcctggttgcgattcgtcagataagaggtacacatacatccacaacaagtacgccatcatcgacgataagaccgtggtcgtaacctcggagaactggaccgatgcgaatctgggcagcaaagggaacaggggatggggagccgtcatagaaagtaccggatacgccacacatatgaaaggagtcttcgaaggggactatgatgtctccaatgcagatgtgaagacccttgacgacgtatatccggacatagtcgcatcaggggatatcagttacaccatacgcgatgactactcttcgcctacgtattccgccagagtggccccggtcacctctcctgataattccaaaagtgctctgaaatacttcatgggatccgctaccagccgcatatacgttgagcagttggatatcgacaagaataattccacacttaccggagacagtcttatcggcatcatgtcggacaaggccgggcagggaatagatgtgaaatacatcctcaacgggacatatgagacatcggaggacaaggattctaaagaacaccacgcactggtccagaccttgaacggcaatacccagataaaggcggccatctacgagaagacgaaggcattcccgcagatccacaacaagggggttatcgtggacgacaaggtctgggtgggatcagtcaactggaccgatggttcgttctataggaaccgcgaggcggccgccataatagattcctccgaggttacggactactatgcggcatacttcaataccgatttcgacaattacttcaatgcggactactcgaagatcaatgtagaggaggagcacaatctcatgtattatctcggagcggccgctgtggcgatcgtcgggatcattgccgccgcgatgaagaaatccgcgaagaaggccgtacgttccgccacctcttcctcgtccaagaagaagtccggttccggaagcaggccctcatcttcgaataagagctcctcgtccaagaagaggaagtgaacactaacctattacatgcagtcctcgggctttaaatcctcagaccggaagacctccgtatgaggacgaggtccgaggtactgctatgcattctcatcgtcgctgccacgacgtcgctgctgggtccgaccattcatgatcccgtggatgccgcagtttccccctccgtcctcataacggaggtcaacccctatgacgagggcgtatcgatacagaacgtatgtgccagccaagtggatctgatgggttggtgcatgaccgatggcgagggtacgttgacgttcaacagaagcacggtcctgcatcccggggaacgtctgaccattgtcggagaggtcggcaagaactggttctgctcacgctccgggacgatccagaccgatgatccgtgcatcacccgtaccggacgtttcatattggccgattccggcgacgaggtcgttctgaaggtaggggattcggtaatagaccaggtctgttggggagggtctctcggagcggacgggtggtctggaagtccggtgaggataagttccctcacatatgccatgaggacgtcccagacggatacggatacgtcttccgattggatggtgacgagggcgggatggacaaactacgtgtttcctggcacatccgctttcgaggcctccgtggttccgttctcatttccggagagcggaggaggtccgatatacaaggcgttggaatccgcatcgtgttcggtggacatctccatctatctcatatcgtgtccgaacgtcatagctcttctttcctccctttgcgaccgcggagtatccgtaaggatactggcggaggctgagccgctgggagtggacataagcacggagctggcattgttgaaatccatcgacgacggcggggcagatgtcaggctgataaacttcggcgaccacccgcagaggttcgtctacgtccacaacaaatatgctgtgatcgacggggacaccgtgatcatcacgtccgagaattggacatccggcaacatgggttacggcaacggtaacagggggtggggggccgtgatctccggaaagggatatgctggctatatggagagggttttcgagaacgacttcgataccgtatggggcgatacggtgtgtttggaggacgcataccccgatctcaagggctatcggggcaccctgtcatatgtacctccggatgtgccagaataccgtagttacgaagcctccgtatctcccgtactttctccggacaattcgttctccaccctccgtatgatgatgggttcggcagagaggaggatatatgcggaggagatggacctgggggattcgctgtcgcccgtgaatggggacacgcccatagcatggatggcatccgcggcatcatgcggattggatgtccggttcatactggattcctcccagtcgggagggggtgcccatgtatcgaccgtgaacctcatcaacgagaccacgggcataaaggcggtcgccgtcgacggaggggacgggttctccctcatccacaacaaaggcatcgtcatcgacggatccgtatgggtggggtccgtcaattggacggccacgtctttcgacaggaacagagaggtcgccgtcctcatcgtctcggaggaggtggcgtccttcttcgcagacctgttcctttccgatttcggggtgagccgtacggacgtcgaagagggagggctttcctttaccgcggaggtggtcaggggcagcggcggatacgccgtggtccttcgtgccagggggccggccgggtccatattcctatgggcggtggacggggaggagaggtgcacggatgtatcggcggcggtgttccacgtatcgtccggtgatcatgtggcatcggtgtcggtggaaggtatcgacgtctcggaggaggtatcgttcaccgtaccttccgaagaccatgggggatacgttatctatttgtcggcagccgtcatcctcctcatagggacggtcgtcgcgttcttccgcgacagacccagcggcggatacggtgatatgggatggagatcaggaagatgagacccgaggattcttcgagggcgtatgccctcatatgcgagtccctggattcctatttcgttccgagcatcgtcgattatttcatgatgcagtggcccggaggacagatcgtggccactgacttcacgggagacataatcggatacatggccgggtcccgcctctccggcgggcgtgtctccatagcgcttttctgtgtgaaaagaggtttccgcggtcagggaataggttcgggaatgctcgacaggttccgtcggtccgccatgatggacggggcgaggtccatacagctcgaggtgagggagacgaattcggaggccatatccttctatcgccgcaggggcttcatgccggtggagaggctggaacatttctacgaggacggcggcactggcatacgtatggtggccaacgtgttcggtgtcggtaattgaatttttaaatccgctcgtgtatcgccggggcatggtttcccaaggcgccaaagaccttttcacacaggctaaggaattctacaccgagggcgaggaccggtccaaggatgccaaggcattcgggatcttcgccgaggcatccaaggccgggtgcatcaaggccgaatattacatgggacgcatgctcgacaaggggtacggcgtcgatcaggactacgagaaggcctacagccactattccgtggccgcagaccatgggaatccggatgcgatcttctccatcggagtcctgtactactacgggcatttcgtggagcagtcctatgacaaggccttcgggtatttcatgaaggccgcagatctcggcaatccgaaggccgtatacaatctcggggtcatgtacgacagcggcatcggagtggagcaggatgcacagaaggccttggagtattataccagggcatccgacatggggagcgagaaggccgagtacaacatcgggatgatgtatcgttccgggaagggcgtacccaaagatgacgcagaggccctgaagtggttcaagaaggccgccgggcgcgggatgctgaaggccatgttcaatgtgggtctgtcatatcatgccgggaaaggggtccctcaggacgagttcgaggccatgaggtggttcaagaaggccgctgacatggggcataagaaatcccagaacatggtggacatgcttcagaagaagttcaatgtcataacgacgataagttgatatgatagcgtcccgagtcgaggaagacccgggagtaaatcgttttccggaattcagttgaacatactgtccgagccgtcgatgtgctcgttctggaagtagtattccgagttctggttctgggcgtcggagacgtccttggtcatacctttctggtacgatccgtacctctccttgatctggtcctccaccgggcgggccctgatcttcgccttcttcacatgctctgcggtgatgagcttggccttctccatgatggccacgtctccggcggcccttatgagtcctccgagctccctgagtctgagtgtgagggagttcttctgtccgtcggccttggcacgcctttttccttcgaggatgatctcctccaccgcatcgatggacgcattgggtatgtgtccgtccatggcgatctcctgcgcaacgaactgggcgtatttggcgcggttgtggctggtgtcgggcatggcggtgtccaccaggacctcgtatccgttcccgattatcctcgacctgaggggggacaggatgttctgtaggtcctgcatgttgcaggcggctaccaatacgaagtcgcacgggacgttgtcgaccttgacgctggccccgctggactgcggattgcggccggtgatggggaatttcttgtcctgcatggcggtcaggatgaacctctggaggtttcccagatgggagatctcgtccacgaacaggacgccttcatgggcctcgtggatggatccggggatgaccctctggtatgccggcactcctatcttgtcgtgtccgccgtaggggtcgtgcctcacgtctcccaggagctcggtctccgaggctccggtggccatgacgaaggggtccctgtccagttttacgagggtcttcgtgttggatttcttctggaggttgttcctcttctggagggccttcgtgtccaacatcctgatcttgttccccgccctctcgaagaccacggtctcctccgtaccgtcggcgagctggcgggtggtgttcaccctctccttgcccgcggacatctggggcattgccgactccagcatgccgaggatgtctccgaacgggttgtttccggcgattcctctgtcgatcttgctcttgccgcagttggggcagttgaggtcttcgggagcggaatagcttccgcaggcggagcaatagtatccgagacgttgtgcgaccttcgcaggggccttctcggggtctatgagctttccgacgctctcctgctgggccgcctcctcggtcttgacggtcttgtcgtccaggatctccaggaacggcctttcggggttctccggattgtgggcgacacggatctcctgacggggcttggggaggttcatcgatatcgcacgggcgatcatcgacttcccggtgccgggagggcccaccagcagcaggtgcctgcgctggatggcggcgatcttggccagttctatggcctcttcctgtcccaggaccctgtccagagggtcggcggggatgagcacctctgcggtgctcttcatcccctcgacatcctcccatgtctccacggcccttttcttcgctgctgccatgtgacgacctcagaccagatcgtccctggtccagacgacgatgtcggcaggcagcttggagatcttccctttgcgcttgcagacgagggtctttatgcctttgccggaggagatgtccaggatgttctgggagatgaccccgtcgaagacaatggtgcggatgtcttcgttatcgctctccttcaggtagttggccagattcttcacctcgaccttgtcgatgacggtgccgtcctccgacatgaggacggagttcttggtgccggtgatgtcggacagggtgtccctgaggctctcctgctcgggggtgaggatcttgtcgctcttgatgtccctctttccgcggagggtcctcggggccctgatggtcctcttgggcttctcctcttcttcggcggccgcctctgcaggggcctcctccttgacaggttcttctgctacgggctcctcgaccgcaggttcctcgacgacgggtgcctcttccatagcaggctcttccacagtaggttcttctgcaacaggctcctcgaccgcaggtgtctcttcgaccacaggggtctcctctacagcaggctcttccgtcacgggttcctcgtcgggggtctcttccatgagcctcctcttggcggggatggtgtccacgatctgatcctcgacgggttcctcctcttcgaacgaactctccctcggtttcttcctgtatctgtcggcggattcgttgtcgaaacggtctcccttccttccgcggcgttttccgtacctgccttcctcatcctcctcgtcggaggtcttcctggagcgcctgctgttgccttcgcgcctcctggtgcccctgtcttcgtcgcggtcctcgtatccgttgcggtggtttctgggcctgtactcctcctccgcgggggtctcatcctcctgctcttcgagttccttcttggattccgcggagaggtccttctcctcgaaggagaggccgttcatctccatgtactggtctccggggaccttgttgcggaggcacttcaccagctgtttggcggaaagctcctcgacctcgtgggcgcggggtgcacgggcgacgtagtcgatctcggcggtctggaagagttccctgaggatcagctcccctcccctgtctccgtcgacgaaggcggtggtaaccctctccctggagaggtcctgcacggtcttcgggacgttggttccctctacggcgatggcgttctttattccggctctgagaaggttgaggacgtcggacctgccctcgacgatgatgatggcctcggaattcttcacgttgggtccggcagggcagcgctccttgccgtaggtggtgatctcctccacctgcacgctctgcctgatgttctgggcgaggtcggcgctggttcccttggactgctcgacgagggagctcaggagctccttcgcacgctcgacgatcttctccctcttggtgatgcggacgtcctcgattccgaggaccttgatggatgccttgcagggtccgacacggtcgatggtctcgagggcggcggcgagtatgacagtctccacctggtcgaggctgctggacatgtagatgatcccctcggacttccctcccttggagacgacgtccacctctatccttccgatccttccggatttctgcaggtccctcaggtcgaggtcgtctccgagaagtccttccgtctggccgaagatcgctccgacgacgtcgggcttgtcgacgatcccgtcggcgttgatcttggccttcaccatgtattttgttgcgttagggtcaatgctgttcaatgaaaccactccgggttcttgtaacaagaaaaatacggtaaccctgttctgccgatacttatcggtgcaacggtcccagttttgcctactttcggctgtccggaccttcgaatcttcccatcgtttgaattgcccaggtgtccttcatcgggagctgcggcggtgattgcacgggagcgtatctccgtgcggatgattgtgatatgtgaacagggaaacggatttcccttggtgatttagggtatcaataataatagatataaaaggttggtaagaagttttacagcatccgtatgatggatggattataccgctatgatgcgggcacccgtcccctccatgaggtcccgtgtttccctgtcgcaggtgaagtagatgacctgtatgtcgcgggagagcttggcgatcgcttcgcatgcgccggccttcctgccgctgtcggaggtgagcaggacgtcgtccagtatcacaggcggtctttctgcggaaaggctcagggagacggccatcttcagggagagtttcacctggtcctcgagtccggtggaccactgtttggagttcttcaggtcgccggtgacgaggtccctcaccacgaggtcgtcggaggaggggtcggatgccatgccgtagcggccgtcggtcatgagcgacaggaagcggtccgcgttcatgatgacgtccggtctgttctccgagtacatctccttggacgcctcgtccagtataagctgctgcagcatcagggacgcccattccttggcggcggaatacaccctgttctcggcaagggaccgttcagttatcgcatcctcgaccgtgaggtcgtcctcgatgttcttcagcgcctgtgcggtcctcccatactcctcggacagtccgttcagtctgttcttggcggaagaatagtcctcctccgccttctccgggtccacatccgcggcctgttcggaggcgttggtcccttccctgagggcggaaagacgcgctctgacgtccttgagggaatccatgtccttcatggccctgtcgaacccctcctctcctccgaatccggagtagaagaggtccagctcatccttcgctctgtccctcttcgccctttctccgttacggtccctgtcggccttttccagggcatggaccaggtcccgtaccgtgttgagcgatgtaacgcacgtgtcgaaggatgtgcgttcgataccgacgtcctcggccaccctgtccgccagacgttccaacctctcgagttccttccggacatccggtccggatgtatccgtattcctcggggatccgacccttcttctcagaaagggcacggcggcggccacggcccctgcgacgatgacggcgatccccgccatggtgccgtacacggtcaagaccgctcctgccgcgatcaggacgatccccgccagcggaaggagtcctcccttccgtccggacgcatggggcttttcttcggtacgggtcttcggacgcatattcagttccctgtacctctgtctctgcgaattcaggtatcctatgtcgtccatatgtctgtatacggcaggtatgtcgcggccgtccagcagtctttcggccgcttcgtaatccttttccgcggccttcgcatccctgtcggatctctcgaacgcatcctggaggagggcacccctcctcctgtcctcctcgccgtatctccccgcataagacagggccctctcctgttcttcgagtccggccatggtctcgcgggtcttctccctctccttctccaatcccgcccggcttctgactttctcacaggcctccgtctccgccctggccttctcgatctcctccgacagcgccctctccctctccacgagggagttgtagtatgcatccccatcctcccgcatctgcaggcggagcacctcttccttggcctcgctgtactttctgatgagcacggacatcctggacttctcgctccggcgtccgtcggggacgtacgacgtcctctcctccttcaggtccctgtataccttggggaggtcgtttcctccgggtatcgtcaggaaacggttccggatgtcccccttctcgaggtcggcggtgttgcggaggtcgtccggctgcatggagtagatggaggtgtattccctgccgctgatcccgcattcggcgtcgacgcatccgatggacttcttcccgtccctctctatcgtccttctgccgccgtcggacatctccacctccagcttcccgcagtcggacctcctggtctccggatacctcacgttcgtcttggagaacagggtgttggtgatgaacgagcgcagggtggatttgccagcttcgttggatccgtatacgacgttcaatcccgggtcgagcgtatactccttgtcggagagggatccgaaggacccgatgcgtatgcggaggatcctcaccgtcctccctcccatatcctgtcgacgagggcgagtgcggcatcgtccaccatcctgcgcagttcccctctttcagcatagtactgcaggtacgggcgcatgtcggaggcggggccctccggacagaggaggtcgaggagctccgagtcggaaagctccgaatacctcttggccgtcctcagcaccccggatacgagcgttttgccctgtgcggcggcctccaggtcggcgtccggccgggtctcgatccctctgacgtccgtactgcacttcgccctttccgcgatggcggcggcgataccctccggatcggacctcaccacatggttgaggggacccctgcctacgaatgtgagacagaccaccgatccctcggggcactcgggtatcaccgagtccacaagttgggacacgtccttcttccatgttatatcggccttgacggatttccacaggacctcctgcgtcggtacgaactccttctccatcgagtctccggtcacggatacaaggtaacatcccttcttcccggtctcgttgggggatctgccctgtatgttccccggatacactatgcaggggtccgattccttgaggaccgccctcttgtgtatatgtcccagggcccagtactgtatgtccttccctatcatgtcggagagtctgcacggagcataatcggcgttatccgagtatccgtcgacggaacagtgcaccatgcctatggtgaacatccccggggtgccgtgcatcccggccgccaggttctccgacgtatgcatcgtcgtgtagctggaaccgattatctccacttccctgcctccgatgttcatcacgatacggtcgtccggtccctccagcatgcgtacgttgtccgggtatgctatgctgccgtcccacgacgtcttgaaatcgtggttcccgcgcactatgaaacagggttttccgaattccctcatcttttcgcagaagaacagcctggttctcggggtctggttggtgtcgtcgtatacgtctccggatatgaccatgaagtcggccctctccttcgccagctccactatcctggagaatgatctgaagacggagtcgtataggcgtttcccgagtccggggttctcctcggtcacggcgtagaacctgctgcccagatgcaggtctgcacaatgtacgaatgaaaaatctgttcccatcgggaataatacgggaggatcgtttttatttttaacgagttctcataacttttgaaagttaaaggccctccggggacggtttttgtcacctatgtctcctgcataatatccagcagaccccggatgagatggacatcatacccagcgacggcgtacccgtctccggtctgccttccatgtgaaaacattattgcggcatgcagggggcggaatatatactgaatagtgtatccaatttaatatcaccgatgcgttcatacatcagacaggaggagagaccacggattgtatcaggaagaaggtcgaggaggagatagggaaaggggacataggctgtaacaggggctgtgactacaacccctgccacttcgacggccaggactgctccttctgctactgtccgttctatccgtgcagggatccggcgatgggatacgatgtcgtatcccgccatgggaaacccgtatggtcctgtgaggactgtctcttctgccaccgcccggaggtggtggagttcaccttcgataagatcaaggagctgggtctcaaggccggggacccgaggttcctctcggaggtcttccccgaggcgaagaggaggttctggcacaaggggaaggcgctcatggtcctcggtgcgacttccgatgccgggaaatccataacggtcgccgccctctgccgtatattccacaggatgggatacctcgtggcccctttcaagagccagaacatgagtctcaactcgagggtcacatccaaaggctgcgagatcgccatggtccaggtcctccaggcccgtgcgggaggactccgcaatgcggacgcccatatgaaccccatcctcctcaagcccaaggggaacaccgcgtcgcaggtcatcgtcgagggcaagccgttcggcgactacgatgtgccagattactatgggaagttcgtcccgggtcccgggatagaagcggtccgtcggaacatggagttcctgaaggacaggtacgactatgtcatgatggaaggtgcgggaagtcctgcggagataaacatctacgacatggatatagcgaacatgagggcggccgaggtcgcagatgccgcatgcatactcgttgtcaacgtggaatggggagggtccttcgcctatgccgtaggcacggtggaacttatgccagagaaggacaggggccgtatcaaaggcataatcctcaacaacgtccgcggggacctcgacaagatcaggccgggggcggagaagctggaggagatgttggggatacccgtcatcggtatcatcccccacataagcctcgaccttccttccgaggattccgaggcgttcagggacaggacgtccagaggtactggcacattgcacatagccgtggtgaagctcccgaggatagccaatttcacggatatcgaccctctctacaccgaggacaccacggtcgagttcgtggattccaccgacggaatacgctcggcggacgccatcgtcatacccgggaccaagaacaccatcgacgacctcgaatggctcaaagggaacgggatgttcgaagcgatccgtgatatgaggggcaaggtccccatcctcggcatatgcggcggctatcagatgatgggcagggtgctccacgaccccaaggggatcgaagggaagaccgccggggacaccgaggggctcggattcttcgacaacgaatcctactgggaagaatataagaaaaggaccgtccgcgaccgctgtgtgatgatcgacggcggaggagaggtggagggatacgagatccacatgggcatgacggatgtgaaggagaagcctctgttcaggatgaccgccgtagatcgcagggacgaggtagagggatccgtccgcgaggatgagatgctgtacggcacatacatccacggggtgttggacaagcccgccttcaggaagaagttcatatctatgataaagcacgacgggaaggcggtccccgttagcgagccggaggattacgacgaggtggtggacaggaatctggatattctcgccgacggtttcgaggagggtttggacatggatgcgctcaagaggatcgcgggggtggaggaatgaggtccgtactgttcctcggtacatcgtccggggccggaaagaccacgttggacgccctatactgccgtcatctggtcaggaagggtctcaaggtcgcccccttcaaggcttccaacctctccctcaactcctatgtgaccgaggatgggaaggagatcggaatgggtcaggccttccaggcatgggcctgcggtatcgagcccaccggcgatatgaaccccgttctcatgaagccttccggaaacggcaggatgcagatcgtcctgaggggggagcctttcatggacacagaacgcggttcttacttccccagagacgagataatggagaaggcatgcgaatcatttgaccgtctggcacatgataacgacgtggtggtgtgcgagggttccggatccccagtggagctcaatctcatggacaccgatatggccaacatcggtatgatgagggcccgcgggatccaatccgtacttataggggacatagagcgcgggggggtgttcgccgcagtatacggtacctggctccttctcccggaggatctgaggcctttgctgaagggattcgtcataaaccgtttccgcggagacgcatccatcctggaatcaggcataaggaaggtggaggagcttaccggaatgaaatgtctgggtatcgtcccgtacgcccttctgaaattccccgaggaggattctttgtccgattcgaagggaagtttgggcgacggggacatacacgacgagttcgtaaagaatctggacgagctcctcgattcggccgaggaggcaggtctggatttcgaggccatagacaggcttttatccgcctgatgcgaccttcatcgccttgacagtctgaccgtcggcaatgggtgtgtccatagggacgggttttccgtcgatcaggaaaaggtatgcgtccgggacgatgcctacctccttggcagcgtccatcacggtggttcctgcagggacctccgtggtctttccggataccgttatcttgcagaccatggaggtccgaggacatgatccgtatatcatcgtttcctatgtcctcccagacttacacattacatgtaatgcgaggttttatctccgtcggacggtcatatgaatgaatgtcggcggaaggaggttttttcggtgcacacgtgcctccttccccggcagtcttattttcgtgtcggcataggccgggtctgaggatcactcctcgtctatcgggatcatgaattcatccatctctttcccgcagtatgggcattttccgaactcaatatatccgccgtccggatcccatccttcggatctggccgccgcctccgcaagttccggatcgaccgtgtacatggagaatgcaccgctcatgcagtcgtcgatggcgatgtgtaccttcatggagacgacatcatctttgaatctttggcaacatacggattggaagaagcaatcccctctgacctttatctcccccatggggtgggagtccagtatggccttctgtatggagcccgccttctcggtaagtctttccattagtctgtccaagccggtctccccgttgtaaatggcggcttcacactcgttcagagcacacaggaggtcctctccttcgagttcatctaccatgtctatggctttctcggggttctcgaaatccagttccatggacatatgacatgcatgtatcgtataatagggacatgatgttattggagtgaaggggtccgggtttcgtttttctgcctattgcatgcatcggggggtcgatatatttacagacgactacgtttgtaaaacaggtcccggaccatgatgtcgcagatgaccccagtctgaagaattcagcgcagttcgcacatccgcattatggtgtgggtcgcacccttgggcgacagctcgctcttcatgatgagtaccgcagggcagatgaacgaagcgaactccgtagcggaataattgtgaagaatcctggatatgtcgggtcttccctccaccctcgccaccgtgatgtggggtttgaacggtttcgtatcgaatgggatcccttcggcctccagcctgcttccgatgtcggcggacattttttcgagggggagggacgtttcgaccccggcccatatgatcctgggggctttctggttggggaaggcacccgtacctttcaccgagatccttcccttggatatcccggatacggacttaaggacgcactcctcgacgacatccaccttctcctcggggatgtcccctatgaatttcagggtgatgtgcatctgcgccgtgggggacggctttatgccgcgtatccctttcagatccctcatgaacgggtcgagcccggatgtgttgggaatcgggatcgatacgaacgtcctcacatccaaggtcttatcccttcctgtcgagggcggccaaggctctcttggccgcctcgttgccggcagcggccgctttcccataccatattctggcggattccacgtccttgttcatgccgataccgtcctcgtagtatcttccgacgatgtacatggactgggggttgcctttctccgcatccttcctgaacatgtcgaacggactttcctccttctgtatggcctcggcggcgcccatggcattgaggatcttcttggacagggtgtggccttgtgcggccgccttcctgtaccactccgtggccttcccatcgtccttcgggaccccgcgtccgttgtggtatatgtcccccatgtaatactggcagaagagattctcctccttcgcacccttctcgaaccatttgcgggcctccgcatagtcttcgccgaccccgttggcatggtaatagcattcgccgacgtacagctgggattttatgtaccctttctcggccagctccatatgcagtctgaatgccttctcggagtccttctccacccctctgccgtgggcgtagcagttggcgacgatgtacatggatttcatgtacccgtcctcggccgccatgctgcagagacggaatcccttctcttcgtcgcgtttgacgccgttgccggatatgaggtcggatccagccatgtggcacccttgcgtactgccgtggacggccgcacgcaggtagtatctgaacgagagcgatgcgtccttggaggtaccgttcccctcggagtagttgtcaccggtggtgagctcggcgaacgggtttccgaggtctgcggcggtcttgaaccattcgaaggatttcctggcgtcttttttaacgagccttcccttggaatagagctgcccgagcatgaccatggcgtccacggaacccctctccgcggccgacatgagcatcttcagcccttcttcggtgttacggttcacacctacgccgcccatgaggcaccgggccatcccgtagtctgcctcgacacatccgaccgtctgtgccacaagataccagctgtaggccatgttggcgtccttctccacgcctacgccgtccatgtagcatctgcctacctcgtactgtgcgacaggtatctttctgtcggcgagttccgaatatgtctcgaaggcggctttcggatcccttttggtcccgacgccgtgttcgaggcaccatgcgtatttcagtgacgcacggaggttgcctttggaggagatctccttgagcatggcggcccctgcggccttgtcgcgtgcggtaccggcccctcttatgatgcagagggccttctgacatgcaccgtcgaggttgcccgcatcggcggacctgcagaacatctcgtacgccttcccgtcgtccaggtcggtacctatggcgaggtcgtagcacatgccggctatgtacatgccggcggccgaaccggcctccgcctttcccgaggcgtactcaaatatgttcctgtcggacggaccgtcggaacgtaccagcctgttcaccacgacccccttggccgggacgtatccgtcggtggcagcatatgtggtccagaacatggattccctttcgttcttctccactgcggcacctaccgcgtagtgctgtccgaccatgtatgcggctataggatgacctgtctccgcggcctccatgtagagccggaacgcctcttccgtctccccattcttcgccagttcctgtgcttttctgaatacggtctccgcgtctgctgttgattcggtcgacatggtatcgtctctgctcaatacggttgttcggtgacaaaacggtcgggcgggtcattccttcggggagtacacgccttttatggaagccttcgccaatatgtgtcccttggacaccctgttcaggtcctccactgtgaacccgttcttcaggacgggttcgaaatccaaggccaggaccgtcaggacgtattcgtggggcctgtcgggaggggagggtccgccgtatgcgctcgcccccttcctgtcggtcccgcgatccatccagctgttcgctccctggacgatgtcggggtccaggcgggacgcgtcctcgtccagataaggttttttgaggccggctaccagccagtggacccacttgaacccgcagggcgggaccgagtccggatcgtcgaacacgatcgcgtacgatgcggtgcccgcaggtgctcccgagatcctcagggggaacgacagcgcaggcatgccgcccgctccgaattcggtccctttcgctccgtacttgtctgcgatcttgccgtccgtgaagccggcgctctcgactatcatgtttctccgtatgttcctgcataaataagaagatgccccgccccccatcgtatttggacggattgtcaccacggaagagtgtgtattcagggagaatgtccgtcttctacaggggcatacgggttctgccggtcgagtcttctgttcctcacgtacaggcacatatctatggccaccaggacgatgtccaggatgtagaatgcgatgacatagttgatctggtcattgacgatcttgttggcgatgccgaagaaatatcctatctcgacgatcacctcgaagactatgctcttccctctggccgtccgggacaggtaggagcgtgcgatgttgaaaggccatgaggccgcgaagcacagaagcatcagaacctcgaaaatcgaagaaatcattctgtcactagcatgccgcctatatcggtgccggctaaaaaaccttgctggggagcggtatccgtctccggaggcctgtattgtttaacgggggttttgtaatctttgagacatatcgttttgtcccttgtcggaatagggagttaacattacctaataacgggattcgattttaatatcaggaattgatgcccatgtcaagcacaatactgtgtgtcataaagaggcgttaaaaatgtactctatgggacctaaggccggacctctcctctccgacgaggaggctattgcgaaatacaacaacgagaagcagtggggactgctcgtcagcatcgatctcggcgagtgcgaccacgacctgatctcctcgaaagaacacatcacccagttcgccatcgatctcgccaaggagatcaacatgaagagatacggcgagccttacgtcgtattcttcggagacgagcccaaggtacagggatactccctctgccagctcatcgagacctctatgatctccggccacttcgccgaggacaccgacaggtgcttcatcgacgtgttctcctgcagggagttccctcccgagaagaccgccaagtacgttcagaagtacttcggagcgaagaagatggagtactccgtctccttcagggacatctgatcagacagcgaacgattctttagaacacacaccggccccctttcaagaggggccggtcatacactgtacaaatttatacatcttttaattatctcggagatattcccttcccatggaatggggaataggccgcagatggacggccttggccgcgacggtgctgaccgtcccgctcatccagatattcgtgttctcagtcatacccgatccgttcgtgggcagtttcgacaagatgggtctgttctacaagagcgggtggaggtccatcggttatttcctggtcctcaccgtcttctccgtgaccgtacctcccgcactgatgtacgcatccctccgcagtccctcccgcagacgttcggaactagggaccgccgcggccctttccatatcggctgcggtgttggtcttcgtttccatgtacggcgcagggctgatggccaaaaacgtcctgtatttcggggatgcttgggacagtataatctgcgcaggggtggtgttgatcgcgttcggtatgtattacatgatacccaacgaccggaatccggagttcgccgccgtgaggaaggtggaccatgccaaaggcatcttctatcagaacatatcgagcctgaccatgacctatgcggggctgaccttgcttctgtcggtcttcctgcagccgcattacctgtgccacatatttgcggtgaccgaggcctcggcctatttcctgtaccgtcacagattcctcagggatctgaggtccggcaggcgtaagacgtgcggcgagtgtatgtgacccggatcagtcccaggacctgttgtcggtgacgtgcttggccttgccctcgaacctttcgagggttccggggaggttcatcttgacgacggccttgaggttgaggatctccttgagcctggcctgtactttggcggacatctcgttgatcgcattcacatcgtcgggcaggcactcgggaagcacctccacatccaccaccatcttatccatgtagttctcgttggtgagggtgatgtggtagaacggggacaggaagggcatctccccgatgacgctctctatctgggacgggaacacgttgatccctctgacgactatcatgtcgtcggcccttccggtgatcctcccgagcctcgggtgggtccttccgcatctgcatttctcccatgtgagggtggagatgtcgccgattttgtatctgatgagggggaatgcctctttctgcagcatggtgacgacgacctctcccgattccccgtccggaacagggttgccgtccttgtccaggatctcgatgagggtgaggtccgcccacacgtgcatcccgcactgggcgtcgcactcaaggaacatggggccgtagaattcgctcgctccgtagcatccgtatgcctttatgccggtcctgtcgtagagcttcttcctcatggattccgaccagggttcgcctccggcgagggctttggtcaccttcgtctgtttacgtatgtctacgcccttctggtcgcatacgtccgctatgtggaacatgtaggacggggtaccggccaggcaggtgacggggaggtcctgcatgagttggatctgtctgtcggtgttgcctacgcccgtagggatgacggtggcgccgaccttctctcccgcataatgcactccgagaccgccggtgaacagtccgtatccgtgcatgttctggaagacgtccttcttcccgacgccgaaggaggtgagtcctctggcgagggactcggaccagttgtcgatgtcggtctgcgtgtagccgaccacggtggggcggccggtggtcccggaagacacatggatcctgaccagttcgtcgtagggtctgacgaagagaccgtccgggtagttgtccctgaggtcggatttcctcatacaggggatcttcctgaactgttccatatcggtgatgtcgtccggggtgagtcctaccgactgcatcctcccgcggaagaactcggacttctcgtacatggtgcggatctcgttctgcaggagcctgaactgcatctctttgagctcctcgacaggcatcgtctcaagttcttcgttccagaaggtcatgttatcgccggtatgatatgtgccagcaaatggcacggtatggtaaccggattattgaatctctatataggttcatcgacagggagtcggagcgacggttccaagggatcccgatgtgccagacctttcgattctccctttcatgcccattgtcggtcattccgtcggttggcgtgtattctcaaaaagccgtatcgccgcagaccgcatgtgcaagagatcaaaatgtttcccggacggtctcccgtccgggtggtgtggtttcagtgtctcctcatgtatacgaatccgaggacggccagcaggatgatcgccacggccgcgacggccacgtagaccgtcatgtcgccgccgtcgtcccctcctccgttctcctgggcgcccttgaccacatagtaggagaagtggtcggtgtcgaacacgaagtgtccggatccgtcgtagtatcctccgacgagatggagttctccttcgtcgtctacatagtacgccttaagggcggagacatcctccccttccttgggttcgtacttcaccgatacagtcacggttcctccgagctcgtgtatcttctcgtcgcctgcggaggcttcgaagcggaatacgagtccgtcgccgacggcttccttctgggcatccgtcagttcctccttctgtaccccgttcatggagatggatatgggggaggttccgtcgctcacggtgttcaggacgtccttggatatcgtcagtgtaccctcgccgaatgtcaggtcgacgatggcatctgcggaggtgagtccgctgacggaattctggtcgaggacgaccttgcccatgccggcggtgtcgatggataccctcttctcgtctgcggatccttccatctgggacagtatgtcggagatggtgtcgccgctgaccgtggcggatccgccgtccgtctcggccgtcacggtggcctccaccttggtggcgttgcatccgccgcagatgtatgtggtgagtccgtcttcggagggtccgttcgtcgtccatgtatgggtcccttcctcgaagtggtcgcatacgtcgcagttgttcctgtgggtgtccttgtcgaagtagatccactcggtgagatggtggccgttggcacctacgatctcggtcttcgtcgcatcgcatgtgctgcaggtgtaggtcttctcccctctttcggtgcaggtgggttcggtggtcacgaccccctcgttccaactgtgttccgccttctcgaagtatccgcattcgcagcttctggaatggtagtcgtcatcgaccttctcccagtcaccgaaggtgtgctcatggtcgctggtgatctcgaatttgacggagacagcgttttcgaattcgtcggaggtcgtgttcctggtcttgattacaagaatgtatgatccgatatccttgggtccggaaatgacgccggtcggtttatcgttcacgacatatctgctgtaatcccacagcgtgccttccttatcctcgaccttcatccaataagggagggcgagggcggatccctcatcaacttcgaacgttttagaactatatccgcatacctcttcccagctaaagtacgagccggagatgatgatgtccttgtaagtgtctatcgtcacgggtgttccgtcgtatatcttgttgaggtcccctgcgaaaatgcatgtgaattcgggttccacgatctccacgtattccttgtagaagtatacgggggaccagtccctgatatcgttctctatggaggtcccggtgaaacagacggtcccgtcctcgttcttcacaaggcgcagatatgtgctgttgatgtccttgcctgcgttataggttatcacagatccggacggcatcatcttgccgcctaccgagaacgattcgctctctccgtcggagaatttgacggttatgccgtattccttataggtctcgttaggggggtagaacgatccgatgtcgtttccggataccagcatggtgccctttcctctttttccggtaccgaagtcccagaggctgttgttgaacttgttcttacttgggatgaacgtcagtacgtgtgtgtctcccagggttatggagtcgtcctcgttcgcgaagacctctatggcctccgcttcgtggctctctccgcttttctcataccccatggcatacagtttgccgttcatctcggccacgatggcgtagttcgccgtgtcgtatccgttgtttgtttcaatgcgttctgtgaactcggactcctgggagatcttgacgtagttggtcttctctatgaccacgtatttgttgtagacctcctgaccgtcgtattttataagtacgtcgtaacctccggcaagtgcaggtcccgcaagataatttgtttccagagttgtgtcgttatacggatccaccttttcgctggtcccgtgtttgaaccattcgatggagaccttctcctctgagaatccctctatctccgacgaccatctcgtcatcggtatgccgttcatcgttatgttttctttatagagcggcagagcccctccgtcgtaccttagactgaagtacggtttgacttcaacggggtcttcgcttgtgctcccttcccccgtatctgccaacagaatatacggtgccgatgccataagcataagtgcagcgaccgatgccaacagcaccttgtgtgcggatatcatgcatgtcaatcgacatcatatgtaataatatcgactgctcatccgttcgtcttcggatgattcccggcacctaaggtttcaggtcctcgaccgtcgccttgtaaggggacctatcttctccggagcatttatggatgttttccggtaacggatcacagggacacggtatcggatgacaccaggacatcctttccgcgtaccgctatcccgtgcatcaggacatctcctttcaatccgtggaagtacttcctgtcgcggatctgctccaatgcgttttcggacgttttccgtaaggtatcgtcactggcgttggaacgggtctttttgaactccatgatgatatgcatcacagatttatctcaattgggtcaagtcaagactcatcgtatcccattactaatcgtatatctgtttgataagcagatgatcacatccgatcaggctttaaatgaactgaagtgcagatacaatcaactatgtgcagacgtaaacgcaaaaagcaacatgaagatggcagtatgttacattatgtccaagttatatcctgtgacatttgattaaaacagtgcagtggttttgcaacatcccgttagacgttatgttgcaaaacatgcacatacaattgatagatgcatcattgaactttaatacttgcttttctaaaagtaattttgtatatcatgtgtcttgaaactaacgttcatcaaatacaatagtatggaagacgtgtgagcccatacctgataacgttgtttggatgttcattcagagttgtcctatatggaaaattaaagattttggtgtgaaaatggttggtggacaataacctgaacgcacacgcgctttttccgtcgaaagacagtgcggacgggtatctttccggcaacgcgattcgcaggataaaggctgttgtggaggacgatctagacgtgaaattcgacctccgcatgtgccgcaggacgttcggacagagatatctggacagtgacgtcgacatcgaatcggtgtcggtattgatgggacatgcgagcaccaaaaccacggagggattctacagcagaaagaggctcaacaaggccatagacaacgcaaggaactcatggttgtccagtggtggacagtgacactgtccatttttcgatgatctgggtagtggttagtggtggacaaggcgcgattcgaacgcgcggcctctgccttgcgaaggcagcgatctaccgggctgatctacttgcccattgaaaatcccggcatttcccggctattggaccaaagaatataaatctactgctcgtaaaggtcgcgatcgcaatgaccgaggcctacgacatcggactggacatcgaaaaaacagcatttgaatcggtctccgaccaggcgtacggccggatcccggagcattactgcccgtccgaagacgacgggtcatgcggcgaattcgcagacgccgtcgggacgaccgtaggcggaagggatgtccttgccgatgtctgcggaaagtaccagatgggcgttccctgtatatctcacacaccgggggcggcgagatgagcaggatctatctggccgggccgctgttctgcgtcgccgaactggaatacaacatgtctctgaaggaatatatggcggagaacggggaggagttggtccttccccaggaatgcggtgccgacatagatcccaggatgatgggatctccggactacgctttttccaaggccaaggaagtattcggaaaggatctgggtcttctggattcatgcgatgccctggtcatgaacctcgacggcagggtcccggacgagggggcctgtgtggaactgggttacgccttcgccaggggtaagccttgtttcggtatcaagaccgacgtccgtgctgcagagtacggcatagacaacatgatggtcgtcggtgcattgggcggaaaaatagcccgttcccgggaggagctcgtctccatgctccgggatgcgggcctgtaagcggttttcacttccttaccacatggacgtggacaccttcgctgtggtccaccaccacggcggtgccggcggggatgtcctcgtcggcctcggcactccatgtatcggacccgatcttgaccttgccctttatgttcccggggctgatgccgacgaccaccgtcccctccttcccgatcagggaatcggagacggtggtggaggggacctcgggcgatcccagcctcttatagaggaacaccgtggcggccgtcaccggtaccgcggagattatggccaccacaggggtccacatggtgtagaagttatcgggggcggcgtagccgtaggccccgacgatcaccaggatggcccccgggatgagcaggtaccctcccgggaagaacgcttccacggtcaggacgacgagcccgagtatcataaccacgatggcaaccgtagcgacttccatgctcatgccttctggttggtgttggcgtcggcaagggcgttggattcgtccaagtccgcctgtaccgtcttcttgaaggattccgtctccttctggacctcttctatggaggggatgggtccgaggatctcgtcgggatctccgacggcctccctcacggcctctgtgtcggatacggccctgtcgggcacgttcttggtggagcccacgtagtccgatatcccgtccacgagcctggtgagctccatggggaagaatatcttggaggattgtccctgacctaccgatttgagggtgtccatcgaaaggacggaaagggccttggagtccatggcggccgctcccaccgacatgatgcggagcttttgcgcctctccctgcgcctccagtatggtggcggtcctggtaccttcggcctccagtatcatggattgtctggtaccttcggcctcgaggatcttggatttcttcttaccctcggcctccaggatggcggccctcttcagaccgtccgcctccaggatggccgcacgtctcttcctctccgcggaggtctgctcctccatggagtccttgaccttcgaggcggggtccacctccttgatctccacgttctcgaccctgactccccatttgtccgtggcctcgtcgagggtgtccctgagctgtacgtttatgttctccctgttggagaggatctcgtcgagctccatctgtccgattacggaacggagggtggtctgggccagattcacggtggcgacatggtagtccgtcacttcgaagaacgccttcttggggtctatgaccttgatgtagatgatggcatccaccgatacgggggagttgtcctttgtgatgacctcctgtttggggacgtccatcacctctgtacggagctccagcttcacgacctggtttataagtgggcagacgaagttgagtcccgggttgaggacgcggatgaatttcccgagcctcatgtagatggcctgttcgtaaggctgtacgatcttcactccgctgaacacgcagacgacgaccgcaaagacgatgacgaccgccaatacgaccaaaatttctgaatccataggtgtatacccgatgacatatacctctttaggtatttagaagtgggccgttttatatcatattcatatgacacttatttaaaatccgcaaacattgggcggagcattggcccgacagaggccggagatgtcattcatgaagcagcttgtcctggtgaggcacggagagagcgagtggaacaagaagaaccttttcacagggtggaccgatgtggacctttccgagaaggggtgggaggaggccaggtccgccggggccatgatgagggacgagggattcgtcttcgacaggtgctatacctcctacttaaggagggccatacacaccgcccacgcggccctgggcgagatggatctggaatggatcgatgaggtcaaggactggaggctcaacgagaggcactacggcgccctccagggtctcaacaagtccgagaccgcggagaagtacggggaggagcaggtcctcctctggaggcgttcctacgacgtccgtcctccggcgttgtccgaggaggacccccgcaatccggggaaggaggcgaggtacgagggcgcacctgccgagggacgtcccctgaccgagagcctcaaggacacggtcgcccgcgtggtcccctattacgaggggacgataaggaaggatgtggaggctggcaggaaggtggtcgtgttcgcccacggcaactccatacgtgcgctcgtgaagtatctggacgggatgtccgacgaggaaatcacgaaggtgaacatccccaccggtgtgcctctggtatacaccttcgacgactcgatgtccgtggtatccaaaaggtatctcggggatgcggatgcggtggcggccaaacagaaggccgtcagcgagcagggcaagaaaaaacaatgaatcctgccgaaacgctacaataaagcgtgagcgggaccgcataatgatttaagaacagtccttcatggaaacacaaaatcgtaaggtgtgaacaatgagcgagtgcaaagttaccgtggatcccggtgtatgcaaactcgggacagtcatcgtcgccaaaccctccgaggacatgatgagcgtcgtcttcgaggtggagacctcctgccccaacatcaggaagatggccgataaggtcggcgccgtcaatgcgtatgaggcgatgggtatgaagatgtgcgagaaccccgtgtatgtggccgccaacgagtgctgcccccatgcggcgtgtcccgtcccctgcgccttcatcaaagccatggaggtcgcggccgacctcggactcaagaaggacgtctcattcaagatcgagtgatcccaaacatcttcgccgtccctcgagggacggctttttctttcacatcccgtcgtaatgtgccagtgcattcaggttgtcatcgggggtcatgggcggtacgccgcatcccggggctattatgccgaatccgcagtcggcacaggcacgggcttctgtaacaacgtccgcaggggtcccggagaggagggtacctaccgggtccacgcatccgatgagcacggcccttccgccgacacgttccaccgcatgtcccattccggctcttttttcgatggagagtgcgtccgcacctgtcgagaccatgccgtcgaggatctcatatgcctctccgcagatgtgcagggactttttgcatccgatcccggagaatatggatctcagacgtcctcctgcgaacctctcgaagtcatgaggaggggtgaggtcgggggaggcggagccctcggtgacctggatgtcgtcggcaccgcaatgtgccagtgtttccgcatacgtctttatcatgggggtcacggcatccagccatccatacacgcgttcgggacagaggaccatccccatcaggaggttctccgcaccaaggacgtgggtcagggtggtgagcggccccgttatccccgccaccacgacaaggtcgtcgccgtgtttctccgccagcgaatgtaccgattcggaaacgaccgtacatctccctccggaaacgaactccgcaggggacatcagatcctccggtacgtccgagaacccttcttccatacggtacggggaggagattacggagggttggctgccgatgctgccgcggtccacggcacatccgagacgttccgcctcgatcgagacgcagaaaggtacgcggaccgttgagaaaccgaaagacctggaacattccaatgccagtttgcacatcatgtctgggtcatagttagcttccggccaacggcttccgcagcgttccatctgggacacggtcgcggtctgtgtgaagacggcggccggagggatgtcttccccgtcgccgttcaaggcatccagcacagcgtctttcctgttcatgggatgtcatcggggaaggtcgataatacgatttcttcagttatcacatctatatttcgtggatgcacgggtctggatgaacgccatgccattgcatgcagagtcaagtttaattccagatgatcgaagtggatttggaatgccgttaggcggggagtccggtgcaccgaggctagaccccctcagcgtgcaccggaaccatcccggcaggaggtgggacgatctttgcgatcaccatcgaacgccggaaacacggtttccagatcacgatcaagaccaaccagggtcaagatcgtgatccgtctcccgtaagggagacgtaaatcttgacccctcgagggtccggtcccacagggatccgttacccatttcacctcggggaaccagagtggtccggagatatgaataagaatcccggtgtcagatattacgacatttggcacatatgatgtgatgttctgtattggaaattcatacggcgtcccggatgtctgcatgttcggtctatgtggtcctctcagttggagtccttacaccaaggcctgatgcgccagcatttgttatatcctaatgcgatgatactttctctatgtcgatagagatacgtcacgacaggtgtgcggcgcgcatatccgcattggatggtgaaagggaggtcgggtatgtcacgtactctatatcggaaggtacaatggacatcgagcatactgtcgtgcttcctgagatgagagggcagggtattgccgcccgtcttgtggacagagcgctcgatttcgcacgtgacgaaggtctgaaggccgtagcctcgtgctcatatgcggccaacgtcatcgctaaaaggtgatcgccacatctccttcttctcccccaccagatggaccaggtggccgtagccttcggtctccatatcctccaccggtatgaaacggagggaggcgctgttcatgcagtatcttgcgcgggtgggggaccagctgtccccgtagaacacatgacccagatgtgtatttccgacacggctgcggacctctatgcgcgtgataggcaggctgcggtcctccagatacaccatggcgttgggatccaggggacggctgaacgccggccatccgcagtggctgttgtatttgtcctgtgagaggaacaggggttcccccgtcaccttgtcgacgaatatccctcttccgaactcggagtcgtattcgttgtcgaaaggcggttcggtccccccgttctgggttatgtatatctccgatcccgacagcgattcgcttatctcctcgtcgctgggtcttttgtatgccgacgggtcgaacaccctgtcggagacctgttttatcagataagggtccacgtgacagtatccgtgctcgttcttctcaagatacctctggtggtattcctctgcgcgccggaacaccttcagttcctccaacaccacgcagaatggtctgtatctcatggcctctacggcggatatccttctgacggtgtcctccgtctccggatccttccagaatatgcacgcctgatactgcggtccgcggtcgttcccctgtccgttctccatggaggggtctatcgaggaatagaacgcatagaccaggtagtcggtgctgacctccgccgggtcgtataggacatgtacggtctcgcggtatccggtggtgcggcggcatacttcttcgtagctcgggtccagggagggatccccgttggcatatccgacctcggtggagacgacgcccgggatggcggacatgagtctctccgtgccccagaagcaacctcccgcgaaccatatctccttcatggatggtcgtttcccgatatgcggataaaaggattcggtgcatgcggaacacggccggtacctgatgacacagttcctgtgtacagaataccaagatatcctccggcagggaatccacatattccgactcggaggaatagaaacgagggccgtagaccaatatggccatgtgcccttctccggaggacacggcgctgcgtatgtcggggaggaaaccgtcacccaccttgtatacggggatatcgggaagtctctcggatatcatctccgcaacagtatcgaggagctcctccttcggcgtgcgcctctccccgagcagcatcttcccccggccctcctccgacagtagttcgtccacattggcggacgcacgtccgcggatgcaggccacttcctctcccatatgtccaagtatgtccgtccagacataaagggacacgcatgccgcagtaacctggtgtttaactattgttatataaagcaagggtttttaggtgtcccctaatatccgagttccaatgtcacttctcgagattaaagacctgcacgtcgaggccggcggcagagagatcctcaagggcgtcaccatgaatcttgaggagggcgagacttgcgtcctcttcggccccaacggatccggaaagtccaccctcctatccaccatcatggggtatggacagaccaccgtcacctccggtaaaatcatcttcaaaggcgaggacatcaccggcatgtccgtggaccagcgcgctaaactgggcataggaatgatgatgcagaggcctccgaacgtgataggggtcaagctgggagaactcgtgaaggtcaccgcagccaacgggaagggcacgacgggacgcgagaacgagttcaatatgcaggatttcatggagagggacgtgaacgtcggcttctccggcggcgagatcaagaggtcggagctcctgcagctctccgcacagtccccggacttcgtcatgctcgacgagcccgagtccggtgtggacctggagaacataggcctcatcgggaagaaggtccatgagctcatctacggctccgaggacggcaagaccagggagaagaacgtctccgccttcgtgatcacgcacacgggacagatcatggattacataggggcggacaaggccttcgtcctcatccacgggaagatcgccagggagggcgaccccagggtcatcctcgaggatatcaagcaaaacggatacggggttgatgacgaatgagcaggatcaacgaggaagaggtcaggaaggccctcggtaaaaaggccgcctacggcgacgatatcgacatggagaagtacgacgagggcgagaaggacgtcgagcagatcgagagcctcgaggacacccccgacgacctccagaagaagatgatcaacgtcggcgtcgacaccgacgactccgagaaggacgggacgatcctcttcatcaacaatgccatgagccactgctccaacaaggcccaggacggactcatcataatgagtacccagaaggccatggagacctacagctgggtcaaggactattattggaacgccatggatcccgccaaggacaagtacacggccaagacctacgaggagaagtccgacgggtattttatctacgttaagccgggacaccatctgaaattccctgtccagacctgtatgatgctcggacaggacaaatccgtccagaacctccacaacatcatagtggtcgacgacgacgcctcctgcgacatgataaccggatgcaccacggtacacagcgccaacgatgctctgcacgtcggtgtttccgagatgtacatcggggagaactcgtccctttcgttcaccatgatccacagctggaacaacgagaccgccgtcaggccgaggaccaacgtcgtgatgaagaagaatgcgaggtacgtgaacaactacgtggtcctcgaccccgtcggcaccatccagtcgttcccgaacgcctacctcaacggggagggtgcatcttgcagtttcaacaccatgtgcatcgcccacgagaactcgaacatagacaccggagggtgtgcgatcctcaacgcccccaacaccggcgcggagatcctcagcaggaacatatcctacgggggcaggatgatcgccaggggacgcctcataggtaacgcccccggggccaaggcacatctcgagtgcaagagcataatcctcaaggacggaggcatgacccaggccatccccgaactggaggccagttgcgccgatgtcgagatgacccacgaggccgccgtcgggaagatcgcccaggagcagatcgaatacctcatgtccagagggctgacggaggacgaggccgtctccatgatagtcaggggattcctggtcggaggcataaagggtcttcccgccaacctccagaaggagatcgacgcggccatcgagaaggccagcgaaggcgattgaaatctcttaaaggagggacctccctcctttcttcctgtacattgtctttgtaaccgatgtcccctccctcttggacgggaccttctttctttaagtatccgagcccatctgcatatatggactacgtcaccctaagcaacggggaccccatgcccatggtcgggttcggggtgttccagataaccgatgccaaacaatgcgagaaggcggtcttggacgccctcgatgcaggatacaggcatatcgataccgctcaggcctatggaaacgaggaggccgtcgggaacgccatagcggccagcggcatagacaaggaggaagttttcgtcacgactaaggtctgggtatcaaacgcgggttacgagaacgccctcaggtccatagaggagagcaggaagaagctcaagaagccgtacatcgacatggtcctgatccaccagccgttcggcgactactacgggacctatcgtgcgatggaggaactgtataggatggggagggtgaaggccataggtgtttccaacttctctcccgacaggctcgtggacctcgccatcaatgcggacatacccccaatggttgaccaggtggagacacacgtcttcaaccagcagacggaggccaggaagtggatggacaaatacggctgccgcatagagtcgtggggacctttcgcggaaggcaagaacaacttgttctccaaccccgtcctcaccgacatcggcgggaagtacggtaagaccgcggcacaggtcgccctcagattcctcctgcagaaaggcatcgcggtcatacccaaaagcgtccatgcggaaaggatgagggagaacatagacgtcttcgatttcaggctctccgagggggacatgggagagatagagaagttggatacaggcacctccctcttcgtcgaccactccgctccggagacgtcggagatgttcaacaggtgggagatctgaaaccgcccggcggtatcccgccggcatcccaccatcatcctaccgtatttcggcgttgttccgaactgctgaaatatgggatgtcaaattcataagttttctacgaaatcagtagtgtttctaccgatttcataaaattatcgttgaaatcatcaacaacatttatttataatcctttctttccgcctccatcgagtcggctttcgatatttcggattgcggcttgactgtgcattgacacaggcgtgataaataatgtctataatggatacgttgaacggagagatatccgacctcttttggttcgtcgatgattatttctggggtatctccttcgttttcctgatcggtctggggatcatattcaccatcaagctcaaagggcttcagatcctcaagatcaaagaaacttcatcactcgcgctttccggggtatcggagggtaagaagacctccaagatctcctcgttcgaagcgttctgtatcggaatgggcgcccgtatcggcgtaggaaacatcgccggagtcgctaccgccatcatgatgggtggtcccggagcggtcttctggatgtggatcttcgccatcatcggttccgccagcagcttcatggaatccaccctcgcccagatcttcaaggagaagaaggaggacggtcacttctacggtggtcccgcctactacgcctccaagggtctcggcaacaggaaactcggtatcatcgccgcggtcctcctcgtcctgaccttcggtgtcgggttcatcggggtccagtcctgtaacgcttccagcgctctcagcggtgccttcgacttcgagaacaaccacctcgtgttcgccatcatcatcgcggcgctcgcagccctcatcctgttcaagggactgaaggccgcggcgaagttctccgcaagggtcgtccccatcatggccgtcctctggatcgtcttcgcactcgtcgccatctgcttcaacatcgatggagtggtcaacgccatcgcgatgatcttccagtacgcattcaccgttcccagcgccctcggcggagctatcggaaccataatcgtcaccggtctgaagagaggagtgttctccaacgaggcaggtctcggttccgtcgccaacatcgcggccactgcgaacgtcaagcaccctgtcaagcagggaatgatccagtccttcggtgtcctcgtcgacaccctcgtcgtgtgcaccatcaccgcattcgtcgttctttcctacggcaacttcgcggagatctccgcacttggactcaagggagcaaacctggttcaggccatcactgcggattccatggggaacatcgcgaactacatcatcgcgctcttcatgttcatcttcgcattcaccagcctgatcggatactacaccatgagcgaatccaacgccaggttcatcaaggacagcaagaagaacatcctgttagtccgcatactcgtcatcatcgtcgcgttctgcgctgcatgcgtcaccgatgtcaccatcatggacgcgttcagcgatacgttcatggcggcgatggctgccgtcaacatggtcatcgtggctctcctgagcaggaaggtcttcgaggcctatgccgactacaggaagcagaagaaggccggagtggaggaaccggagttccacaaggacgccctttccgacgccaccggtgtcaccgaatgggagtgatacgaatggtcacgatagagcagtgcgacaagatcatccctatactggggatagtcaccatcatcgtcggcgtcttcaccggatactacttccatgggggagagaacaatctgatgttcgcgcccctcctggtcggtttcgtcctcgtcttcgtcatgtattatttcatcgacaagagggcggagctcaaggccggtaagaaggtagacgagttctgacgacggggaggcggcaggataccatcctgtcgccgaccctaaacgattttccggttctggaacatcctggattattcttttgttccgacggcaatattaggaatcccgagatatctgttgttttacacgggatatcggatgcagtatgtgaaaaaagaccgtgcgggatcagagcttcatactggtccagcagagttcgcgggtctcggtgtagagggcccctcccgactgcaactgtgtcctgacgtccctgaagacgatgttgtccttcccgaggaagaccctttccgatcccccgtcccggctggattcgaaaatgttgacatatatgtgtccgaagggagtggtcatattctccgacccctttttctcgaggtcggacatatcgaatatgcaggagccgaacgtcgtcttcgtttcgaacgtctccgcacctgcaccgtcgacctccctctgtacggtcacatcgtcgccgtcgatcttgactatggtgtacttctcgatggacgggtctttgtggttccttcctccgcatgatacggtaagctgatatgcgaaccacactcctttggtaatctcggtcatcgtacaccttcttctgagacatcctaggtctcaggtgttaataaaccctgtgtaccgacggcctgtttttacacgacgtaccgtttatttggtcgcacaaatgaagaaggagaacggcagatacacggtctcaccgtccttgacgactttaagggaatcccttccatccgtatccacctttatcgtcctgacccccagctctatgagggtgtccacatcccattggggcctcctctgtgaggaaagcgggagttcctccgcgatcctctccattatcttggggtcgacgtttcctatcctgtcatgggattcggcatattccggggcctgcgaggcgtagtccttgtcatacaggtacaggtagtggttgccgtcgaatatcatcagtttcccctcgggtttcaggacgcgcagccattcgcggtatgcggccttggggtcgtccagattccatacgaggttcctcgatatgacaaggtcgaaggtctcgtcggggaattccaatacctgtgcgtccatccttttgaacttcgcatccactccgtatctggcacagttgtttccggcctggtccagcatggcctgtgtacagtccaccccggtcacgcggtggccgagtcttcccaggaccaccgggaagaatccgggtccggtaccgacgtccaggacgtcaaggtccccgcattgtcccagatgttccaggattatgttcagccaatggctgtaggtgcctttctctatctgctcggtgacggtcccggagtatccggaggccctctgcgtccagtactcctctatgctcatcatgtggccctcgggcatcagctcacacctccgtcgtagaagaagtggctgaggtccgagaatcctttgacgacgaacctgttgtaagaacaggacctggagttccaatgttgacggagagtcgcggattctgccatatggccattggtgggagggtctaggatataaccttgttgttacttttttaaaaaaatcacataattgttatgcacttgttttagaaatggtgtttatactccttcagcctcatcttgtatccgatctccgcccatccgcacattatcacgagtccgacgatctcgcagattacgaatccccaccacatggcatccggggatatcgtgcaggtggccccgaacacgaatatcagcaggatgttcctggcgaaagtgctccacatggagttgttcgccatacgcatggcctgtaatagggatgaagagatgttgatggccgagaacaggaccccgattatcaggaatatcttggtgacatggattatgtcggccctcatggcgatggagccctcgctataagtgaatattatcgcagcatagtccatgaacacatagaggacggcggctatgaccgcggttatgatcagggtccacgccatggcataaccgtaagagaatctcatcttggggaagtcgtgtttgctgaacgcggccgccgctatggggaccagggccccggcgagggctacggacggcacgagcatcaggtccacatacttccaagacgtcgcatagacggcatatccgtaggagccccagcagaataccacgaagtagttcaggacgaagttcacggcggccatgatgtcgctctctacggccttgggtacccctacggaaaggaagtccttcaggacatgtttttccatcctggcacttttcacatggaggtctatgtaggtggtttccggtttaacatagtaccagtaaaggaacagcaggagggaagcggcggtggatgtgacggtcgcccaggacagtccgcatatgccccaatcgaatacgaacgtgaacagggggtcgaggactatgttgaggacggcggccgtgaccatcatcaccatggatctcctggacgcaccctcccccctcaatatgcctgcgaatatcccctggaggattattatcggagctcccagataataagggaggccgtaggcctttccgtcatcgtatgtatcggtacctccgaccgccatgaggacggggtcggctatgaggagcattatcgggatgcagagcagtcctatgacgaacatgaacttgatggataccgacgctatgttgtcggcctcctccttgcgtctggtagccaccttcgcggctaccgacgccgatatcccgatgcctatcccggaacctatgccgctcagtatgaggtagaacgaggttacgatcccgacggcggccaaggcgacggtcccgagactggagcaccagaatgtgtcgacaaacgtgttgacctgggccaccatcagggagacgaacatggggacggccatgaggcggagggccgtcttagggtcccccagcatgttcttggcatcggccgtcaactgtttctccgccatattccgcccccattcttataaagggacttgttctcggtactataaatagtccttggaatgggggcatgaagtggtttttcaaagaagtccggcagacctcagggcctgatctatatcggacatgatgtcctccgcatcctctatccctacgctgaacctgaagaacccgttatggaatcttttgtcgtagaggtgcatcctctcgtcgtcctctccgaggaacactatgaggctctcgtcatgacccagggagacggcggacgtgattatcttcagatggctgacgaactcgttacatttgtcgtgtccggccttcagtccgaaggaaatcatacctccgaatccggacatctgggtcttagccacttcgtatccggggtcgtcctccagaccggggtaggagacgaaactcacgcatggcagcgacttcagatgtctggctatttccatggcgttctcattatgggccctcatcctcagaggaagggtcacggaccccctcatgatcatccatgcgttgaacgggctgatcacccctcccagattcacctgggattgtgcccttatgatgtccaggtcctctttccttcctattatcgccccgcccatggcatccccgtgaccgttgatgtatttggtaagggattctacacagtagtcagcacccagctctatggggcgttggttgtatggcgatgcgaacgtgttgtccaccgagagtttagcaccatgccggtgggcgatgtcggcgatcctcctgatgtccgatatcttcagcgtggggttccccggcgtctcgatatgtaccagtttggtattggggcgcatggccgcctcgaccttctccgggtcggaagagtccaccatggtcgtctccaccccgtacttcctgttgaagagttcgttcagaagcctgtatacggcgatatacgtgacgtccgagaatacgacatggtcccctttgttcagggtggcgaagaacaggccggagagtgccgccaccccggaggcgagcaccacgcagtcctcccctccttccagggaggcgatcctctcctggaggaatctctggttggtcccgccgttcctcgtatacagattggctcctgcatcgctccagttcaggacggacgggtcgtaggggagctcgtagctgttggccatggtcagagggcgttttatggctccggaatccttgtccacgtcgttccccacatggaccgcacgggtccggatccccaattcccttccgtattcccgggtcatgggggtcactccatgtctccccacagtcccttggagaagtagcggtcccctctgtccgggaatatggtcactatgttggcgccttcgacctcttcggacagctgcagggatgcccagagtgcggccccggacgacgatccggccaggaccccctcctttttcgcaagttccctgcaagtggccatggcatccttgtcggataccttgatgaccttatccaccagcgatatgtccatcgtactggccacgaagtcgttgcctatcccctcgatgtcgtagtccccgtgttcgcctccgcctatggtggagcctatggggtcggcgaggatcccctttatcttcggattcctttccttgagatacttcactattccgctgaaggtccctccggaacccgcacctgctacgaaatagtctatgcgtccgtccaggtcacggtagatctccggaccggtggtctcgtaatgggcctggggattggcaggattcctgaactgcatcatgcctaccatgtgcggatcattctctatggcctccttcgcccttctctcggctccgagcatgccttcttccctaggggtgtggatgatgttggctcccagtgcgcgcatcacggccagtttctcctgggagaatttggtggggacgtagaacgttacgttgtagcccttgttgagggccgccatggcgatacctatgccggtattccctgcggtggcctcgactatggtgtatccgggcttcaggacgcccctcctttccgcatcggcgatcatgtacatccccacacggtctttgacggatccgccgggattggcaagttccattttggcgaacagattgttgttgttccccacacccatgtggttgatcttcagcagaggggtgttgccgatggaatcgtgtatattgtcaagatatctcaattcgatcactcttcgaagcttccaatgcctgctcgatgtcctcgaccagatcgtccttgtcttctatccccaccgacagtctgatgagaccgtctgttatgcccactttctccctgatgtccttgggtatggacgcatgggtcatgcttgcagggtggcacacgagcgattcgacccctcccagactctccgccaatgcgatgatcttcgtggaagagaggaatttcctgtggtcgtatccttccgcgagttcgaacgagatcattcctcctccggcacgggcctgacggctgttgacctcatatccggagtcgctctccaatccggggtagtatactttcgatacggccgggctcttctgcagatattccgctatgtattgggcgttggagcagtgacggtccatcctgaccccgagcgtctttatacctctgaggagaaggaacgagtcgaacggtcctagcacccctccggtggcattctgcaggaatgcgatgcgttctgcgagtttttcgtcattgacgacgaccagtccggccacgaggtcgctgtgtccgccgagatatttggtggcgctatggacgatgatgtccgccccgagttccagaggcttctgcaggtacggggtcatgaaggtgttgtccacgatggtcaatatcccgtgccttctggctatttccgacacggccttcaggtcggtcacgaacatcagggggttggcggggctttccacgagaaccgctaccacatcatcggcgatcgctttctcgaaggagtccagatccaaggtgtctgcgatggtgtacgttatcccgaagttgttgaacaccttgtccaggacacggaatgtgcctccgtagacattgctgccgatgactatcctgtccccgctcttgaaaaggctcaggaccgccgttatggcggccattccggaaccgaatgcgaatcccgctacacctccttcgaggacggcgatttccttctccaccgcctccctggtcgggttgcctgtcctcgagtactcgtatccgaggcagtgtccgagttcgggctgtctgaaggtggatgtctgatatatcgggacgttgacggcccctgtgcgggggtcttccccgccatggccgtggatcagctgggtgtctgtcttcatatctatcgcttctgcggatggtccgctattaactatagttatgatgatacgatatttataatttaatgataactaaattcataaaagaatactatcaggttgaccgatccgcagatcggattttgatagaataaaagtgaagtgtgcccggaaagacgaagcagctttgctttccgggcggattatgaggagagagcttcggggccggtcgccccgaagggaagtggtttgtcaaaggaggttctaggactcagagtccgtagttcttcatgttgaagttgggtacgacgccggtgaattccttcacgcactgctcgacgaaggcgtcctcctcggtggggagggcgacgatcttcttcttgcagtcctcgaggacatcgtactgcttcttggtcagctggagggtcttggagttgtatccgctctcgatgatctcgatggccttctctgcggctgccttggacctgaggtagtagctgtcgccgttctctgcgatgacctttccgatctcgtaggcgttgttgtaggcgaggatgtaggactcggggctcctggtcatgtcggtgatgcagtacaggtccctcagggtcttctcctggtgggtctggattgcagtgttcatgagagcaacctcgtatccgagggatccgagccagcactggacggaggttccaccgaactcggggtggtactcgacggactcgttggaccagcagtcgcagacctgagcggacaggttacccatgaggtcgcagtgagcgcactggcagttctttccttcctgggtggtgggctttccggcgatggccttgcagatgattccctcgtatccgcagtccttgtcgggtccctgtgctccggcctcccatgcaacaagggtccttgctgcggagatggcacgggtgatggcgctgaaggtcttctggacatcgttgtccatcattccgccggccatgaacatggagacgtttgctccagagcagtcggtgtctcctccggggacggtcctgttcctctttgcgatgtcgaccatctggttccagatgtagtccatgtcgatggatccgaggtatccgactccgaacaggaaggcgacgatgtctccgtgggtgacggcgtagtcagcgaactcttttccaccgacggactcgacggaaaggttgtctgcaccgttctcgcatgcgtagtcgcagcactcgaagaacttctcggggtatgcgtggacggagtccattccggggcggagacccatgtcgtgctccctctggtcggggatggtctgcctgacaccgcaagcgatgccgtactcctcgtggaacttctcgcagacctctttctgtcctgcgacaacgggtgcgcagagcttctcctggttcatctgggagacccactcggtctcgaggtggactgcggggaatccggcggtgactgccctgttgaggatgtcggtggtgatgtagtcgacgtactccttcctcagcttggcggggtccttctcggttccgggcctaggtgcgtagttgatctcggggacaacctgtcctgctccaatcttgagtccgaatccctcggacacggggtgcagtgcggttcccattaccatgtcgtcggcgctcttgtacgccattccagtgtattttacagatgtcatttcagttgcctcctacgatgtcgtcccactcttccctgatcttcttccagtcgtatccgtcgaggatcttctgggcgattatgggggtctggggtgccttcctcgagtagattccgaggtcgtaagagttggcgaactccctgttgactgctcctccgcatcccatgagcggggtgttcaggccggcttcctgcatgagtttggcctcagcggggaaggcggacatggtggtggtcatgagggcggtaccgctcatgaacagaggcttgacttcgatgcacttggcgacggcgtccttcacaggcacgtcacgtcccatgtcgatgacagtgtatccagctgccctcatcatgactgcggcgatgttctttccgatgtcgtgggggtctccctcggcagcgtgcatgatgacggttcccttcgtggaccttcctccggggacctgcttctcggcgatagcgattccgatctccatggtcttggcggccatcatgatctcaggcaggtagtagacgtgctctgcgtacagctttgcaacaatctccattccggcgacgagtccctcgttgatgacatcgagggggtccttcgaggcgagtgccttctgtacagcgggtccgacatccttgaacttcatgaacaggaccttctcggcgacgtccttgaagacggggtcggccggcagaagcttctttgcagcttcctcgggggtctcagcgttctggagctttatgtcgtagcgagtcaggattttagaaaaatccactccctgaatgcttatcatattcttcttcctccaattcgggatttcactcccgacaatggattatacatctccattctatttaagctattggacgaacatatcaaccaatgatatagcaataagcataggttttaaatattaattcgatggaatattaatccaacctattgaatttacatttatttaatgttcgtttaaatcatgcgtaatgtgtcggataatgcagggatttcacagtttttccgcatgacggcacataaatttaggacttccagaaaaaatgcttaataggtattgtacataatactgatacatgatagtctacattctaggtggattcctcgggagcggcaagaccagtctgctcatgaggcttgccaccatgttcagcgagaggaaacagaaggtcgcgatccttgtcaacgagtccggggagatcggagtggacggagcgaccctcaaggcacagggatacgatgccgtggagcttccttccggatgtatatgctgttccctcgcagggaccctgcagagcgccctcaagaacataaccaacgatatcgaccccgacatcataatcatcgagcccaccggtctcgcgctgccccacaaggtcaaggacctggtccacaacgcatgtatcgacgaggacagggacgtcatcatcgggatcgcagacatacagaggttcaaggacctcatcaagaagaaggaggaattcttcaccaggcagatgcagggttccgatttcatcctgatcaacaagagcgacctcgcgaaggacggggagatcgaggaggccacggcatggctcaacggccgcttccccggaaaggaggtcatccccgtatccgtgaaggagggtacgaacctcgacaaggtcttcgagatgatgcaatgagcgaagacaaggaatgccactgccacgagcacggcgaggagtgccactgtcacgaccatgaccacgagcacacctcgatcgaggaggccggcggatgtgcggcaggttttaccgggaccatcgagaacttcaacagcgatgccgagatgaggctcgccgacgcactcatggccgtcggcaagtatgtgcagggggaatccggatgccttctcggtcacatcaaggccgccgtctatacagaagaaggtagcgggctcactctcaacctcatcgacatggacaacggtgtggagcatcatggaacgcttccccgcgcggatcatgtgaagttcaatttcatgtgtgcggtcctcgatgtggacgagcacgagctcacccacgagatgatgcacgccatagacgactccggactcgactacaagatcgaccccgaatccctgcatcaccaccatcaccaccatgatgatgacgatgacgacgagtgcgaggtcgacgaggaaggacaccaccaccatcaccatgacggggagtgccactgtcacgaccaccaccatgacgacgatgaagaggaatgccactgccaccaccatcaccatcatgacgatgacgatgaagaggagtgtcattgccacgaccaccaccatcatgaagacggggagtgccactgccacgaccacgaggagaaagaggaggagaagcctaagaagaaaggtttcttctccaggttctcccgcaaggacaagaaggattgagcaatcccttggatcacattcaaacggagagcggccttccgccctcccctttttctaaatatacttaataaaatctttaacttggaggaagaagaatgacttacggaatcgccatagacataggtaccagcgggtccagggcacatgccgtcgacctttccgatgggaggatcatctcgacggtcaccacggagtgccacccgttgcccggtgccaacgtcatggatcatctgacgttctgcataaacgtagggaacgatgtcgcgcacaggatcctgatggacacggagaacaaggttatcgacgccctcgggatcgacaagcacaagatcgagaaggtcagcatctgcggtaacccgatccaactctcgcttttccagggtatccccgtagacgacctcgccttcgccggagagaatgcgaagagggagaagggcataaaggaacagaagagggatgcaggggtgttctccgcagtggacgtcggtctcgacgtacccgacgggaccgaactctacgtgcctcctgcgatcaggcacgagatcggtgcagacgcacttgcgatgatgtacaaatccggattcctcgagcagaaggccaactgcatggtcaccgattacggtaccaacgccgagatggctctgaaggtaggggatgacatctacaccggttcggccgccgcgggacctgccatggaaggacagtccatcaggtgcggtatgctcgcatcccccggcgccatcagcgacctcgagtacgacttcgcatggaaatgcaaggtcctcgacgactcgatcaccccgcaggacggagacactttcgatttcagtctcggaatgcagaccgccgaggggcctatgcacggaaaggccaagggtatcaccgggaccggtgtagtcgcggccgtcgccgtcgcccagtacgaccatctgtggaagaagggtaaactggccaccgaggacggcaagctccatctccaggacggggtctacgtcgactccaaggacatctccgaggccgccaaggccatcggggcgatgagggccggacacttcaccttgctggaacatgcgggtatcaagttcgacgagatgcgcgtcatgtacatggcaggggcatcaggtacctatgtggacgccatgaaggcgagggacataggtctcatcccgccgtcgtccaccgagatctaccagtggggaaacacgtccctggccatggccaccgacattctcaggaagccggagctgcttgacgagctccagggcatcgccaacggcataagggcgaaccacatcatgttcgcctccgacaaggtgttcgagcagatctacatgcaggaactttcctattgggacgaggggatgtccatggagatgtacaacaggaacaacgccatggtcggcatccaggagctgcctaagcccaagggacgtgccaacgtccacaggatggtcgcccgcgacatccccgatctcggagagaagggactcaccatcatccacaacatcggtacgcagctcgtcgggaagatggatggctgcaccggatgcaagaagtgccaggcggagtgtcccgagaaggcgctcaccatctccgacgacaaggtcatcaccgtacagaccaagaactgtctcggaaccgcctgctacaggtgccagatgtcctgtccggccaaggtctaccagtacaacaagctccagcttgtcgacaactgaaaactgtaacgggagggggcaacccctccccctttaacatccggagaggtcagaaccttcttctgccgttcttcgacggcccgttcttctttttggcgttggggtcgtaggacttgagccatttgacgaggtcggcgtccttatcggtccatgccggggtctctcccgcatcgatgtattcgtgataccatttctcggcatccgtcatcggtcccgacatgtcgggcctgtctacggttatgaggacggtgttctcaggtgtaggtacccagaagttggggcggtcgtagtcggcatcctccaggaatcccacggcgaagacgatcttgtccaatcctgaaagttccgcatacagccctgcctgcatcatgtacgtctgggggacgatggtgacgttcccttcctcgtccagccatctctccttgtcgtgggatgtcttgatctcgagtatggcctgtctcttgccgccgtatgctatgtatccgtccaccaggcctccgaagaccttgttgtcgtggaagtggtcgtatccgcacttctccttctccaccggttcctcgacgatgacgtcggtcccctcgggaagtcccagatcggtgcacagggtcttcgcgttcttccttacataactcctgatgaccggctcgagtatgttcccggcgtcgatgtatttgttcgctttgtcccccggatatatcccggcgagttccagggcgactttgaaaggagtggataggtcgctcatgccgaggatcggtcccagcttcgtacctgatatcttcttcttcctgtacaggtcgaatgcgacgatcctctcgtcatcgtcgatctcgactatgttcgcccttccgtcgaatgccatgtctcgcccatggcgttacacgtattttgtgatgacgttgttatgtgtagggggcaccaccgtcccttgtgccgggatcggcggaccgggtctatgatcccttatggggccgatctcctctgtaccgacaggactatcctgcggacaagactcctcgggaagatcctgaccagtaaaaccatcgccttgaaggttataccgtggactgcgacggccttccctttcatcatgcaacgatagccatacatggcgacggcgcgggcgtctgaggaagtgctttccttgaagacgttggccccgtctgcgttggcggtcttggcgaatcctgtgttggtaggtccggggcagagggcggtgacggtcaccccggtgcctttcagttcggccgtcagggcctcggagaacgacaggacgtaggccttggtcgcatagtagacggacatcagaggtccgggttcgaaggatgccacggatgcggtgttcaggatcctcccttttccgcgggagatcatccccggtaggaaaaggcgggtcagatgggaaagtgccagcacgttcaatcttatcatcctgtcctgtttgtcccagtcgcattctgcgaaaggtccgtagtctccgaaaccggcgttgttgacgaggatgtccacctctatcccctctttatcggcgatctcgaaaaccttgcggacatcaccgtcctccgacaggtccgagcatatgacggtcacattcctcccgtacagggattccagctctcctttgagtttctccagcatgtcggttctgcgggcgacggcgattatgtcgtagccttctttggccaggatcctggtcatttccagacctatccctccggaggctcctgtgatgagggccgtatctgtcatagatgcgtgtagaggggtgccgatataaagataagaccgcccgatgaatccgcggacgatccccgccgcggatacatggatcacatgtgccagatgtcttatatggtgcaggggtggggattcgaaccccagaatcactaagaacaggatcctaagtcctgcgccttttcctagcttggctacccctgcccgtgcgtacaaaggccatgcacttaatatggttttttgttccgacgcggtcccgcatgtgccggaagggcattccgcacacacatctaataaaggacgaggggatacggacggcaagaaggagggggcgtacctcctccgaaagaaggaatcgcatgacagatctattgtcagacagcggaagacagctcctcctcggtaacgaggccataacccgcggcctcttcgaggcgggagtgaaattcgcatccacatatccagggaccccgtcctcagaggtcgggaatctgctcgaggaatattcggaaagggcaggcatgtacttcgagttctcttccaacgagaagaccgcggtggaggtggcggcggccgcggcatcctccggcgtcaggtccttcgccttcatgaaacatgtcggactgaacgtcgccgccgatccgctgatgacgctcgcctattccggcgtcagggccgggatggtcataatgtccgcggacgacccctccgcccacagttcccagaacgagcaggacaacagatactattccaccctcgccctgatccccatggtggagccctccaacccccaggaggcgaaggacttcctggccgaggcgtatgccatatccgagaagctgggtcttcctctcctgtacaggacgaccacccgcgtcaaccacgcccgttccgacgtcgtcttcggggagataaggacggacacccccctcaagggtcatttcgacaaggacgaccagcacttcgtcaacatccccgcctacgccgtccacaacagggtcaggctgttggagaggatgaaggaggccggggagatgtcggaggcatcccctctcaacaggatagagggcgagggggacgtaggggtcataacctcgggggtctcctattgctatgtgaaggagttcgtgtccggggtctccatcctgaagctcgggttcaccaacccccttccggagaggaagatcgccgatttcgtccgcgggaagaaggccgtcatcgtcgtcgaggagctggagccctttgtggaggaccaggtcctgaggatctgtgcccagaacggcataatggtccatgtgtacggcaagagggacggtaccctcccgcgggagtgggagttctcacccgataccatgcagaggctgaaggacatcgtcgacgtcaaagcggcgcccgtatccatggggaagacggacatcgccctgcccggaaggcctccgtccctgtgtgcgggatgcccccacagagggatatatgcggccaccaagagggcggtcggaaagacccccgtcgtctactgctcagacatcggatgctacaccctaggggtgcagcccccgttcaggacggcggatttcatcatatgtatgggagggggcgcaggtgcagcaggcggtttcgcacaggcgaccgaccagaagcccatcgcattcatcggcgactccacgttcttccatgcgggggtgcagcccctcacatccgccctgttcaaccgccacagcatcgtcatggtcatcctcgacaacaggaccaccgccatgacgggtcaccagcccaatcccggtacgggaaggcatttcggcgggatagacaccgatgccgtggatatcgaaggcgtcgtcaggggactcggcgtcgagttcgtcaggaccgtcgacccgtacgacgtcctttcctgcgtcaaggtcatgaaggaggccgtggacttcgacggtgtcgccgtggtcataagcaaatgcccctgcccgctccttctcaagaaggagaagcgtctggagaagaaggtgtgttccgtcgaccaggacgagtgtgtaagatgctacacctgcctgaggaccatcgcctgccccgccctcgtcaagaaggacgaccatgtggaggtggatccgtcgcagtgcataggatgcggcatgtgtgcgaacgtatgcccgaagaagtgcataggggtgagacagtgaagtattccgtccagatcgtaggagtgggaggacagggtgtcctcctggcctcgatggtcctcggtaccgcggccatgagggccgggcacaaggtgaggatgagcgaggtccacgggatggcccagaggggagggagcgtcctctccacgctcaggttcggggacgacgtggtcagtcctctggaggctacaggcggggccgacctcataatggggttcgagcccgtggagaccgtgaggtccatgggtctcgggagcagggacacggccgtcctcatgaacctcgacccggtctaccccggcaacgtcgcggccggtttcgacacctatcccgacgtggaggccctggttagggagatcgagggcaggaacggccacgtggtgacggtcgaagcgaccaggatcgccgtcgaggccggaaaggccgtggccgccaacgccgtgatgatcggtgcggtggccgcgatggaaggattcccgctggagagggatctgctcaaggaggtcctcctcgagacggtcccgcagaagttcagggacctcaacgccaaggccttcgatatgggttacgacgccatatccaagcgtgactgagaaaaactattcccggcggtgcgggcgatccgtgccgccggtttttttttcggacgttcagtcctgttgcgacccgtccatatcgaaacggatgagtctgttcagttccaccgcatattccatcgggagttccttgctgaaaggctccaggaatcccatgaggatcatctgggtggcctcctccctgctcaggcccctgctcatgagatagtacagctgcccttcgctgatcttggagacggacgcctcatgttccagataggatgtggagttcctgaccctgttgtgggggactgtgtcgctgtaggaatggccgtcgaggatgagggtgtcgcagcattccttcgccctggaaccctcggccttcggcccgatggttatctccccgcggaagttggccgtaccgccgcctctggctatcgatttggatatgatgttggatgtggaacccttgcctatgtgaatcatcttcgcaccggtatcctggaactgtcccggtcccgctacggcgatggaagtggtagacccgtgggaacggtcccctttgagaacgcagcacgggtacttcatacagagcttggagccgatgttcccgtccacccactccatgagtccgtcctcgtccactatggccctctgggtcaccaggttgaggatggagttggaccagttctggatggtggtgtacctcatcttcgccctcttcccgacgaatatctcgatgaccccggaatggagggactcctgcgagtacatgggtgccgtgcatccttcgacgtagttcagctcggcgtcgtcgtccactatgatgagggacctctcgaactgaccgctcctcttgttgttgatcctgaaatacgactgcaggggcatgtccagtttgcagcccttgggtacgtagatgaaggaccctccggaccatacggcgctgttgagggcggcatacttgttgtccgtagggggtaccagtttcccgaagtacttcatgaacaggtccgggtgttcgcggaggccggtatcggtgtccaggaagatcacgcccttcttctccacctcgctcagcatgttgctgtagacggcctcggactcgtaatgggccgtcaccccggcgaggaacttcttctccgcctcggggataccgagtttgtcgaaggtcctcttcacatcgtctggcacatcctcccatctctccgccacgccgtcgctgacgcgggtaaagtaggtgtaatcctggaagtctatgaagtccagggacggtccgaaggacggctgtttgtgtctgaagaactccctgagggattccagacggaagtccagcatgaactgcggttcgtgcttggccgcggatatcttcctgacggcgtcctcgttcaggcccctgtcggtctcgtagaccgcatttatgtcgtcgcggaactcgtatttcgcacgctcgtccccgtcgaagatctgtttatcctcggtcattccctatcctccttcgcggcttccttgaatatcctgtccaatcctctccagccgatgttggcgcaggttatcctggccggctgacggttcacgttggcgaaggcctcggcctctcccaggaggtctgcgtcgtagggtttcccgtcgagcatcctcccgaactccgccatcacggcctccgcctcttccacggtctttccttttatgatctggatcattatgctggtggacgccatcgatatggcgcaccccgaaccgtgccaataggcctcggcgatctccccgtcctctatcctgatctgtatgtagatgtcgtctatgcagctggcactgtccatatggacggtcaggaaggacgggtcgtcgacggtcttcacccccctggggtattggtaattgtccgtgacgatctgtttcattatctccggatgttcagttaaagaagacatctaagaaatcctccgcatgtctgctggcctctaccagcgccttgacgtcgtcctcgtcgttgtagatgtacatcgatgcgcggacggtcgcttgggtcttcaggaactccggcagtatcttggcacaatgcgtgccggaacggacgaacacccccctgtccccgaggtacgatgcggcgtcctgggcgaagaccccgtttatgttgaatgtgacgatccccgtgtcggaatcggcgttgtacaggacggcgttgccgttggcgagcattccgtcgacggccatcctcttcagtttcctttcgtggtcgcggatgttccggaaccctatggattcgatgtatctgcacgcctcggccaggcccatggcgcccgacatgttctgggtcccggcctcgaagcggtccggtacgtcggagagcgatatgctgcaggaactgtcgaaacgtgcgttcatctcgcctccgtagaagagaggctccagaccctccaaccgttccctcttcccgtacatgacgcctatcccggtgggacccagcatcttgtgtccggagaagcagaggaagtccacgtccgtctccctgacatcggtctcggagtgggggacggactgcgccccgtcgtccacatatacggcccccacggaatgggctatcctggccaattccctgaccgggaggggacgtcccaggacgttgctgatacttgccagggccaccaccttggtgttctcgttcacgaccgacttcaggttctcgggggtgatcctcccgtcctccgtcagaggtacgtactttatcgaggcgccggtgatctgggccaccctgaaccacgggagggcgttggacgcatgctcctcccaggagaggacgatctcgtcgcccttcttcagtccgggcatgagcccgtaggccacgaagttgaggcccatggtgtccccggatgtgaatacgacctcctcggggtcggcgttgatgaatcttgcgacggtctcgcggctctcgtcgtaggccacgtccgcatcatgtgccagcgcgtagtctccgcgcttggtgttggcgcagatgtccgtatagtatctgtcggacgcctctatgacctgcctcggtttgaatgtggtcgcggcgttgtccaggtagtggaggggtctgtcgccgtacatgccgccgttgcggtacatggggaaatccttgcggacctgttccgtgtcgatcaaaggccgatccctcccattatctccttcgccctctcggagaggcccttgtccgcgaaggagtccactatgggcaggaggctccctacggtgatgagtctcttgctctgttcttccgtgagtcccctgctcatcatgtagtatatggccgcggggtcgtacgctccgagggcggccccgtggcttgccttcacatcgtcgtcgtttatcagaagggccggcgagacctcgctgtcggacctgggggacaggttggttatcctcccgtcctggcgggtgtcgctgccatgggccccgttggcgatgtacgacgtccccaggaagcggaggacgccgtcgtcctggttgatccccgccatggcggtacgggaccagctcccgcctccgttgtggcggacgtccaccgagaacaccttcgtgtgtttccccgtgcatacggcggccaccttgacggacgccctgccgtctccggagaggtctattctaagagtaaggtcggtgtccgagggggacaggtccaccaggacgatgtccagttcccttcctccgtccaccttgtacctgatatccgccttacctccatccaaggccttgatcaggagcaggtctatccgggagtcctcggatatcctcccgcccggtatgtcggacgggtccgggtccaccaacgctctgtccgtatcagtccaccccgagggacatgatgttgggcgctttcgggtcggcgacggacttcttcttggacaggtcgatgccgtactcggaccgcaggaacgagtatccctccttggacaccctcttggccagggacgagtccccttcgagggccacggagccgttgaccatgatggcggtgcggttgggggagactatgtcgtagagtctgtcgtaatgcgatattatcacgaacgtggtgccctgggcacgcatgtcgtttatgatggcggcgatctgggcgagggcgtcgacgtccaggcccgagtcgatctcgtcgaggaagacgaggtccggtttcaggaggagcatctgcaggatctcgtcccttttcttctctcctccggagaacccctcgttgaggtggcgggacgccatgtcggagttcaggccgaccttcttgtatgcgtcctcggtgagtctgtagaagtcgtaggccgagacgggttcttcgcggcggacgttgaggctcgcacggaagaagtcggatgccacgatccccgggatgtccggggggttctggaaggccatgaagatgccttttctgctcctctggtccgcggtgagggacaggaggtcctccccgtcaagttctgcggagcccgacgttatgcggtattcgggggagcccatgaggacgttcaggagcgtggatttgccgtgtccgttgggccccagcagtgcgaggcagtcccctttctcgagggtaagactgagatcgttcaggatctcttttccgcctgcttcggcggacaggttggatacaatgagcttttccattttcaacctctgatcggatggcacatactaggccgtcatcattatttaggtttaccctaaattttaatataggtgtacctaaaaaatctaatctggatagggggtgttaactccgaaaattaactatcgttggatgaaaaaataacaattgttatatatcaggtcgtacgggttcccgcatgcagtgtccgtgcatttattctacatatgtgtgatatgtaaaaatgtataattatattcattaatcctcttttttagacatacatttatattctacctgataattgagagaaatagttcgataatattcattaatggacacaaatatacattaagagggaacaagaatgctcaaaccatccatcgaggagataagggagatcgccgcatccggcgactacaggatctgtcccgtgtgcagggagatcctgtcggacttcaagacccccgtagaggtcatgagggtcctcatgaacgtctccgagcattgttatatgctcgagagcgccgactcctctcacagatggggaagatacacattcatcgggtacgaccccaagttggacatcacgtgcctgaacggaaggatgagggtaggggacctgaagttcgagaccgacgaccccgacatgtacataaggcaggtcctggaggagtacaggagccccaagatccccggattcccgtccttcaccgggggattggtcggatacttctcctacgactatctgaagtattccgaaccctccctcaggctcgacgcggaggacaccgagggattccaggacgtggacgtgatgctcttcgacaaggtcatcgtcttcgacaacttcgcccagaagctcctcctcatagccaacgtgaacctcgcgcatctcgagaccgagtacaacagggtagagatggaactgaagcagatggaggacctcctccgccacggggcccccaagaaggatctggggggcaggatggtctcggaggtcaaacctctcttcgacagggagcagtactgcgccatggtggaggaggccaagaggcacatccgcgagggggacatattccagatcgtgctctccaacaggctggaggcggatttcgaaggcagtcttttcaacacctacagggtgctcaggaccctcaatccgtcgccgtacatgttctatttctccggttccgacatggaggtcgcaggggcctcccccgagacattggtcaagctggaggacggggtcctccatacgttccccctcgcagggacgaggccccgcgggaagaccgccgaggaggacgagaggctggaagccgacctcctgtccgatcccaaggagctcgcggagcacaacatgctcgtggacctcgggaggaacgacatcgggaagatctccaaattcggatccgtcgaggtggagaaataccactgtatcgagcgctactcccacgtcatgcacatcggttccaccgtccgcggggagatcgcggacgggaaggacgccctcgatgccatcgggtccatactcccggccggtaccctttcgggggccccgaagatcatggcctgtcagctcatcaacgacatggagaacaacaagagggggatctacggaggagggataggatacatcgacttctccggcaatctggacctctgcatagcgatacgcatcgcctacaagaagaacggcaaggtattcgtcaggagcggggccggcatagtggcggactccgtcccggagaacgagttccaggagtgtctcaacaaggcgcaggcggtcgtcacggccctcaggagggcggaggaggaagacctatgatcgtgctcatagacaattacgacagtttctcctacaacctctatcagttgatcggatccctggacccggacatcgaggtcgtaaggaacgatgcctgtacgtcggaggacatcgacgccatgcatcccgatgcgataatcgtctcccccgggccgggaaggccggagaacgcggggatctgcgcggacgtcataaggaagctgggtcccaggtatcccatactcggggtatgtctgggacatcaggccatatgcatggtctacggtgcgacggtgacctatgcgaagcatctgatgcacgggaagcaatccatggcggaaatagacacgggggaaccgctgttcgccggacttccggacagcatccccgtggcccgctaccattccctggccgcggaccctgcgacgatgccggattgcctgaaggtgatcgcggaggcggacgacggcagcataatggccgtaagacacagggagtaccgcgtatacgggctccagttccatccggaatccataatgaccccggacgggaagaccatcatggccaatttcctggccatcgcgaagggacaggaggtacatcaatgataaaggaagcaatcatcaagatcgtcgacaagcaggacctcacctacgacgaggcatatcaggtcatggacgagatcatggacgggaagacgacggcggtgcagaactcggccttcctggcggccctgtccaccaagagcgcgaaggcggagaccatcgacgagatctccggctgtgcggcggcgatgagggaccacgccctgaaggtggaccacgggttcgacaccctggagatcgtcgggaccgggggcgacggctcccacagcttcaacatatcgacgacttcggcgttcgtcatagcggcgtcgggtatcaaggtgtccaagcacggcaaccgtgccgcatcgtccagctccggggcggccgacgtcctcgaggccctgggggtggacatcgtccagcctccggagaaggccgccgccctgctcagggacgtcggaatgtgcttcctgttcgcccagacctatcattcgtccatgaagtacgtcggttccatcaggaaggagctgggtatccgcaccgtgttcaacatcctggggcctctcaccaatccggcccatccgtcgtatcaggtgatgggtgtctacgacgagtatctcgtggagcctctggcacatgtcctgtcgtccctcggggtgaagaagggcatggtggtgtacggccaagacaggatggacgagatctcctgcagcgccccgaccaccgtatgcgagatcgacggagggaggtacgagacctatgagatctcccccggggacttcggcatcgaaacgtgccgtaaggaggatgtcggaggcggcagcgcacaggccaacgccctcataaccaccaacatcctcaagggtgccagagggccgaggcacgacatcgtccttctgaactccgcagccgggctgtactgcggcggcaaggccgacagcatggaggacggcatcgatctggccaggaagctcatagacgacggcgcggcctacgggaagctgaccgcactgaaggaagcatcgaacctatgagcgacatattggatacgatagcgtcctatgcggagcagagggtcgaggaggccagacggaaggttcctctcgccgtcctcaaggaacaggccagatgcatgggtcgtgagacggggttccccttcgagaaggcattgtcccggaaggacgtatccttcatctgcgaggtcaagagggcatccccgtccaagggtctcatcgatccggacttcccgtatctggatatagccagggagtacgaggccgccggtgcggccgccatatccgtcctcaccgagccgaaatggttcatgggcagcgacaggtatctgaaggagatctcgtcccaggtgtccataccctgcctcaggaaggacttcgtcgtggacgagtacatgatctacgaggccaaggtcctgggggcatcggccgtgctcctgatatgctccatcctggacgaggagcgtcttagatactacatcaagaccgcggacagtctgggtctttccgccctcgtcgaagcgcatacggcatcggagatacagatggccgtcgggtgcggtgcgagggtgatcggcgtgaataaccgcaacctccgcgatttcaccgtggatgtgggcaacagcgtgatgctcagacgtctggtgcctccggacatattgttcgtgggggagagcggcataagcggtccggaggacgtggaagccctccgcagggccgatgtcgacggtgccctcgtaggggagtccatgatgcgtgcggaggacaaaaaagagatgctgaggttcctgaggggataccgatgacccgtatcaagttctgcggtatcaggagggaggaggatgtcggatatgtgaacctcgtccgtccggattatgcgggcttcgtcctggcccccggattcaggaggacggtgtcggcgcaggaggcgggaaggctctcgtcccttctggatgaagggatcgtaccggtcggggtgttcgtggacgaacccccggagaatgtggcgaggctgttggaggacggtacgatatccatcgcgcagctgcacggcatggaggacgaggagtatctgtccaggctcatggacctcacatctggcacattgatgaaatgtttccgggtatcatcccgcggggatgtggaggccgcatcgtgctgcagtgcggacctggtcatgctggacagcgggaccggcacggggaaggccttcgactggtccctcgcagaaggtctgggaagggatttcttcctcgcagggggcctggacccctccaacgtgggggaagcgataaagaggatgcatccgacggccgtggataccagttccggtatcgagaccgacggtttcaaagactatgagaagatggaagcgttcgttaaggccgtacggtcggcggacggagaatgacgtaagaggacatcactatgacaaatcctaacggaagattcggcgactacgggggccaatacatgcctgagaccctcatgaacgccgttatagagctcgaacaggcatatgacagatacaaggacgacccgggattcaaacaggagctcgacacccttctgaccgagtacgccaacagacccagcaggctgtatttcgccgagaagatgaccaaggacctcggcggtgcgaagatctacctcaagagggaggacctcaaccataccggcgcccacaagataaacaacgtcctgggacaggcccttctggcgaagaagatgggtaagacccgtctcatagcggagaccggcgcgggacagcacggtgtcgccacggccaccgcggccgccctgttgggcatggaatgcgtcgtcttcatgggggtcaaggacatggagaggcaggccctcaacgtatacaggatgagactgctgggggcggaggtcaaaggagtatccacaggtactggcacattgaaggatgccgtctccgaggccatgagggagtggacctcccgcatcgccgacacccactactgtctcggatccgtcatgggtccacatccgttcccgaccatcgtccgcgacttccagtccgtgatcgggaaggagatcaggcagcagctgatggagaaggagggacgtctccccgacatgctcatcgcatgtgtgggaggggggtcaaacgccatcggtaccttctacgacttcgagaaggacgagagcgtcagactcgtaggatgcgaggccgctgggaaggggatagacacccccgataccgcggccacgctcaacaccggcagggtcggcatcttccacgggatgaagtcctatttctgtcaggacgagtacgggcagatcgctcctgtgtactccatatcggcgggcctcgactatcccggcataggtccggaacacgcttggcttcacgacatacacagggccgaatacgtcgccataactgatgaagaggccgtcaacgcattcgaatacctctcccgtacggaagggataatccccgccatagaatccgcccacgccctcgcccacgccatgaaggtggcgcctacgatggacaaggacaagataatcgtggtcaccgtctccggaaggggggacaaggactgcgccgccatcgccagatacagaggggtggatatccatgagtgacatcgccaaagcgttcgaccacggaaaggcgttcatcccgttcatcacctgcggggacccggacctggagacgaccgcggagatagtcagggccatggcggccgccggcgccgacctcatcgaactcggtatccccttctccgatccgaccgcggagggtccggtcatacagggggccgacctcagggcgctgaccggggggaccactaccgacaagatattcgacctggtcaaggacctgaggaaggacgtggggatacccatgatcttcatgacctatgccaacgtggtgttctcctacgggtgcgacaggttctgcaggaatgcatcggaggccgggatagacggtctcctcctttgcgatgtcccgttcgaggagaagggggatttcgaaccgtactgcgacagatacgggatcgacctgatctccatgatcgcccccacgtcggaggacaggatagcgatgattgccaaggaggccaagggattcctgtacatcatatcctccctgggggtcaccggtgtgaggaaggagatcaccaccgacctggcacccatggtggagcacatcagacggaatacggacatcccgtgcgccatcggcttcgggatatccacccccgagcaggccaggaagatggcgtcggtggcggacggagcgatcgtcggcagcggaatagtccgtataatcgagaaatacggaaaggactcgccggagcacgtcgccgagtacgtcaggtccatgaaggacgccataagggatctttgacccgatatccgtccggaacgtccccggacggatccaacatattttttccgatgaataggaaaggtcccgggtgacgggggatctccccgtcggagtggtgaccccgacctcccggcagagaacatttgcgatggcagtcgcagaccgggaggtcgttttgtggaggattccggctgaaatatcgtttcatccggcagtagtttcagtttacgagagctgtaccgtcttcccggtactctccgtgcctttgatctcgtccgccttgtcggcggcccttctcttcacgatcataggtgcgtccatgacgaagttgtctatcgacttgacgacggacatgttgaccatggagagagcgtcccccatggtggagacgccttcgtgtgtcagggacttgtcgttgaagacctgtacgagatacgggcacctcgcatgcagagacctgtgtccctcggcggccttgaccgccctgtcctcctcgaaggagaacggcatgatgtcgatggcggccacggtcactccgacgcggtcgcagagttctgcgatgacaggtgcggcaccggtcccggtacctccgcccattccggcgacgatgatggccatgttgtagctgctcacggcactcatgatctcggattcgtggatctgtgcgcatttctttccgagggcggggtcgcctctggtcccgagacccttggtgacctctttgcagatgtatatcctgttgtcggcggaggtctcctcgagggccttcttgtcggtatttatggcaatgactccgacacggctcatcttcccgtagagcatagaggctatcctgcagcctgcaccgcccactccgatgaccgctatgcgcgggtctccggagacggcgacatccgacaggacgttctccctcgcttcctcagttgttatcattctgcatcccccatctggtgattcttatggtgtgcggatgttctgtataggcggatcctttatcccgagggtccgcccccatcccttctgactggctggccttttcacatcatccgcgaggcttcctgagcagccttgaaggcgttggtcttggtgttctccaaggattcctggggaatgagatccgacatgacgagctgcctgatgtagctctcctcgtcgaagatcacgccttccttcttcaggttctccatagcctggatcagtacctcgctgaggcggacgtaaatcccatcctcgcctgcctcagcaggtacttttttgtcggctatgtagccgcggatggcatcgcgtatgaaagacgaaatggtgacgtcgagatcgttctcttccatgaagtcctgtatgagttgcatgtcctcgctggacagtctcaccgagatcttcacaccttcttcgcctgtcatgtcgatgcttcctttgcaagttgcagagtacccatcccgttgcttgcaatgttataatacacttaagatatataaaatatcggacgtgtgtctcacatattcggggtttttgtcagacaacagaggacagtataggaccaatcccttcataggagggaggtatccgcatcaagtcctgtagtttttctctacattaccccaatatgttacatgtatttgaatcataacgtgttattttttctcgcagaaatctctttatactttgtttgtccgccgtacgtcagacgaaggggtggtacaccggacccccatccaccgtgtcggggaccccaggtctcccggttatcggattatttatattataccatacaatcgcgcgcgttatagaaaggtgaacaaatgagccgcgactacgccgagatggagaagaagtggcagtccaaatgggctgagaagaaactgaacgagtccgagaggcaggacgggaaacccaagttcatgctgatcttcgcatacccgggtcttaccggatacctccatgttggacatctcaggggatacacgtacgccgacgccctcggcaggtacaagaggatgaccggatacaacgtcctcttccccgtggggacccatgccaccgggaacggggccatctccctcgccagcaagattgccaggaaggacgagaagaccgtcgactatcttctgaggaacggatgccccgaggaggagatcgacaagctcaaggagcccatggatgtggtgaacttcttcaacaacgtctatcagaacgactattggaagaggttcggcttcctcgccgactggaggaggttcacctgcaccctgtatcccgactatgggaagttcatcgagtggcagttcaccaagctgaaggagaagggcctgctggtccagaagccgtactacgcccccttctgccccgtccacggccccgtcgccgtggatccgagcgagaccgacatatccaagggcggtctggccgagacccaggagtataccctcctgaagttctggtgcgaggagaggaagttcttcctcgtggcggccaccctccgtcccgagaccatcttcggacaggtctgtttctgggcgaggcccgatatggaatactccatagtcgagaaggacggggagagatgggtcgtctccccgcagtgcgcggagaagatgtccctgcagttcgacggagtggaggaggtcgggaggatcgccgggaaggacctcatcggtctgacatgcaccgcccccatgatccacaagcagatccccgtgttcccggccgacttcgtcgaccccgacgtgggtaccgggctcgtcacctcctgcccgtccgatgcacccgacgactggaactctctgcaggtcgtcaaggcgaatcccgaactgacggagaagtacggaatatcgaaggacatcgtcgatgcggtcgtacccgtctccataatatcgatcaaaggatacggggacttccccgcccagtccataatcgagaagatgaagatcccctccgtgaaggaccctgccaagttcagggagctgatggacgaggccaagaagcaggtctacaaggacggataccacatgggtgtcatgaaggacgtctgcggcgagttctctgggatgcgtgtcgaggaggccaaggataagatccagcaggccatgctcgcatccaaggaggccgagatattcagggacctcacggaggaggtcgtctgcaggtgcggacagagggtccatatcaagaggatcgacgaccagtggttcatcaactacgccgacaggcagctcacagactccaccaaggagcactgcagggacatgaccatcttccccgcccagtactacgagaacgtgcagggcgtcctcgattggtacagggagagggcgtgcgtcaggctcggcaactggctcgggaccaggttccccttcgacaacaagtggatcatcgaggccatctcggactccaccctgtaccctctgttctacacgatctccctgtactccaacaccaagcagataactcccgagcagatgacgcccgagttcttcgactacgtcgtcctcgagaagggggaaccgtccgccgtcgcaggaagcaccggtatagaccaggaactgctggaaaagatccgcaaggacgtccactactggtatcctctggatatcaacctgggaggcaaggagcacatgaccgtccacttcccggtcttcctcatgaaccacagggccatcctgcccgacgacatgcagcccaagggcatcatagtcaactggtacgtcaccggcaagaacaaggacaagatctccaaatccaagggtggtgcgcagcccatacccggtgcggtcgccaagttcggtgccgacagcatgaggctatactacgcccacgtcgcgagcatgttcgtcgatgtggagtgggacgaggacctggtattcacctacaagcagaagctcgagaacatcatgtcctcagtggaggacctcatcaatgcggaggccgacgtgccttccggggacatcgacgcatggctgctctccaggttcaacacccatgtctcggagatcagggccgccatggacaggtacgacctcaggcagatggcaaccgtcgtctattacgacatgtccaacgacatgcgctggtatgcccgccgcggcgggaagaacagggataccgtcatgcaggccctccgcatatggatcaacgccatgatgcccataaccccgcacgtcgcggaggagctgtggtccgaggcagggttcgagggattggtctccgaggcccagttccccgaggccgacgattccaagaggaatgccgccgcggagtacggtgagggactcgtacaggaggtcatcggcgatgtcaacgagatcaagaagatggcgaagaccgaggtgtccaaggcggtcatctacaccacccccatgtggaaggtcggcgtgatgaaggacgccatcgccatggcggaggccgggaacctgaccatcccggacctcaccaagagatgcatggccgacgagaatctgaagaagaggggtaaggagacctccgacttcgtcaagaagatagctgtggacctcatgaggtccaacctgaaggacaagaaggccctcgcagacctcgacgaggagaccctcctgaagtccgccaaggacttcatcgcatcggagaccggtatggagaccgagatctacggagccgacgaggagaacaagttcgacccctccaacaaggcccgtgtagcggtccccggaaggcccgccatctacctctgctgacgggaaggccggcctcgggccggtcccttccgtcatgaaaccgttttcattcctttttgcacatgctgtctatgaatccggtggcgaataggggataatgttccaccccgttttcgtccacccggatgtccccgtcttccagttttatgaaacgggtgatcggccctttttctttggccatgttgtcgagggtcctggaggccctgtcctttccggattttacctccatcgccgcgatctcctctcccaactggactatgaagtctatctccctcctcccgttatgcatgtagtagagtctgcgtccggatgccgctatggcgtctgcgaccacgttctcggtcacaccgcctttgtttacagagggatgtttgagaaggatggatcttcttgtttccacaggatacatgttcataagcatacccgtgtccgacatgtatactttgaacgaatcgatgaacatgttggattccagagggaatgtcggttgttttagattatagcagtattctataagtcctgcttcatacagccacagcaggtttcctgcatactttcttgtcgacggattgtttccttccatcacatcggcatagacgaatttcttgttggttttggtaagctgtgcgggtatggaatcaaggcaggcacgggtctttaccctgtcggatgcgctcgagtatgtggctatgtccgatttggtgacactcaggatgttctttacgacgtctgctgcaagattgaaatccttcttctctatgaatgtggtgacggctttgggcattccgcctattatcatatattgatcgaacaggtcggtcatggctttcatcaagggtgcggagaggggcgttttctcggatatgcatgatttcacctcctcgatcaccttttcatcaagacccatcccccagacaaattcctcgaaatccaggggtctgagggtcatgtcggtctcatatcctactgggaatgatggtacttttttcagattaacacccagaagggacccggaagcgatgacgtcgtatcttccatcgacagcaaaggctttcagtgcggttctggcacggggacagttctgtatctcgtccaatatcaataaggtggatccctcttcgaatttgaaccctgtgcggagtccgctcaaaagcatggttatgtggtctacattgagattcccgtcgaatgcggatttcaggtcctcgtcgatgtcgaagtttatgtatacggtattcttgtaattgtcttctccgaatttccttattatgtaggtcttgcctacctgcctggcgccctttatcagaagacatgtgccgttcttggcttttttccattccaggatcgaatcgtatatctttctcctaagcacgatagacgatgtggttgtgagtataaatattcaacttttatgcatgtttttgaaagtaaatattcaagtttttgtaagttttaaaatataaatattcaacttttatgcatgtttttgaaagtaaatattcaacttttgtgcaaatatggaggtataaggatcaggtatggttcgacggtcgtccctgccgggagaccacggcccttcggtgttaatgcagaataccggggttggagaagtgcggactatgcgtcgtattcggaagatccgaggacagatgcggccggtcggcgatatgtatgtgccagcgtcactccgggggattctctccccatgccctgaacaggtcctgctccacgccggcctgcatgaggcacctgccgacgacgaatccgacgatgtcgtctaccgtcttgggttggggatagaaggcggggttcgcatccattatgacgaccccgagtctggcgagcttcagttcgttctccagcattatggcgctcttcggggtctccctcaccacgaggacggtcttcctctgttcctttatggcgcacatgaccgccctcgagatcagggtgtcggctatcccgcaggcgaacttcgccaccgaggactccgtacagggtgcgacgaaaagcacgtcgtaccggaaggacccggacgcgatgggggcggcgaggtcgtcgtcggaatagacggcatccgccatcccttcgacctgttccaccgaataccccgtctcggccgggattatcctcttcgccgtctccgacatcacgaggatcctctctccggggagctcctgcaggagcctgaccccgtagagggccccggacgcaccggtgatggcgacgacggacctcacttcagcctcaccgtctccagattctggggggcgaccgtctggatgttgtacttcttgtagatggaggaggcgaggtcggtacacttcctgtcctccccatggccgatgatgatcttgtcgggccgcgggtcgagcttcctgatgtactccatcatctgcttcctgtccgagtgtccggagaatccgtcgacggtctcgcggttcatcttgatctcgacggtgatctgcttgcccttggaaggcagggtgatctccgtccttcctctctggatggtccttcccagactgttctcgctctggtatccgacgaacaggagccagttcctggggtcgtccgcccattccctgaagtactcgaggacgggccctccggacatcataccgccggtggcgaggacgatgcacgggtcgggggagtggcatatctcctccctcatgtcggcggtctccaccctgtggaagatcggggagaggaaggggttctcgttcttctggaatatctgggtcctcagctgggtgttgaggtactcggggtatgcggtgtggatggcggtagcctcccagatcataccgtcgaggtacacgggcagcggcgggatggcctccgtcctctccagttcctctatgacgagcatgacctcctgggaacggccgacggcgaagacggggatgaggatcttaccgccgtgggtacaggcctccttgatgtactccccgagctgttcggacgcgtcgtgcctggagggctggtagtcgttgtggcctccgtatgtggattcgatgaccagggtctccagcctggggaacttggtgttggcggggttgaaaagccaggtcttctcgtatttggtgtcgccggtaaaggcgatgttgtgcagcccctcccccacgtggaagtgggcgatggcggacccgaggatgtgtcccgcgttgtggaatgtgagtcttacgtcgggtgcgatgtcggtggtggaaccgtatttgagggggatcgtgtggaggatctccttcctgacgtccttcgcatcgtagaggttcttcttcgcctcgccgtatgcgagtttgatgttgtcgagctgcagcagggccatgaggtccctggtgggctcggtgcagtacaccggcccctcgtatccgtacttgaacagggcgggaagggtcccgcagtggtcgaggtgggcgtgggtgatgacgaccgcatcgatgtcggtgatggggttcgcctcggggatggcgaagtagggggtggcgtcggacccggggtcgaggccgcagtcgatgaggatcttgctgttcctggtggtgaggagggaagccgacctccctacctgcctgaaacctcccatggtggtgaccctgacccattgctcgccctcgatgacgggacgcacgaggttcctcgcgaccttcttgagcatggcggagcgctcgtccttgctgtacctgaggtatcccctgacgtccgagatggtcttggacggtatcggaggggacctcatgaccttgacgttccatccggattccttcttcagggcggacaggatctcctggtcgttgatggcgccggggttgatggcctccacgaaggcctgtccggtatcgggttggaagttgatgtccgtgacctcggccgaatcggggatcatggaacggatcttcttttccaccttgtccgggtcctccagggtggacgggtccggtctgatgtcgaccctcctcctcacgctcatggccatgttcttggccacgtcgacgtttccggagaactcgtcgtagttcctcacgtatatggccactatggggccctcgaactcgatggacgagatgtccatgttggagggggccaaccccttcacctgctccctgaggctgtcgaatagtctgtctgggttcattttaatcggcttctttgaaagttatatcggaattttgtatcgaaaatcgaaagggaaggggtttttccggatggagggtgcaccaccctcagttcgggtacttgaacccgagctcctcgcagcgcgccttgatgtcctcctgggggacccactcgtaacctttgggcccgatgtagaggatcagcatgccgtcgccggtgtagttgtccctgcgcctggcggcgttgaggccggcgatggccacgtcgatgccctccttcttggtcatgtcgggcttgtagagggtctccagcgcaccgtaggcggtgatggagccggatccggaggatgtgtagtcgtcctcgatgacccctccggcgccgtccacgctgaagacgtggccgccggtgcggtcgtatcctgcgagtatggggccgaggtagaaaccctggcggatgacggagcccatgagggtggcggccgtctgcacggacatgggggctcccttctgcatggtgtagatggagatctgactctgcatgtacctgaccatgagctgtgcgtcgcccacgagtccggagatggtcattcccaggttgtcggcgagggggtagaccttctgaacgtggctgttggcgatgaggttgttcatggtcgccctctgatcggtggcaaggatcacaccgtctttgatcttcattccgatggtggtcgttcccgtcttgacaacattatcagattcaacgttagcgttcattcttcttaccttcgttcaataaatgaccgaaaagaactccgggcatgctgctcgggtgttatggatggagtaataatgtccttctaattaaggtttaggtatcggtctcggggttccgtccacgcaatacgcaggatgggcatattcctccgacggggagccgatcgacttcgacggcctccatatggcggacgatgcggtcctctatgcgctgtgggcatgggaccaatacgacgtcgtctacaaggtagacggcgagatagtattcacggacaccttcggctacggcaccgaggtgaccgtccgcgacatcttccagaagaccgggtacacggtgacggggtggtccaccgacgatgccgaagtctccgacggtaagtttgtcctcagggcatccgacgtggtattcacggcctcctcttcgataaaccggtactcgtatgccgtggaattcgtggacgagagcgggaactctgtcgccgagaaggtctccggtacggagtactacggctccacggtcgatacggtgatcaaggatgtagtcggctacaccgccccctcggaggcggtcaaggtgttcatctccgaagatgaatcgaagaacgtcgtcagatatgtctacaagataatcttctacaccataaccttcgacgacggaaccgtgcagaccgacgtcaaatacaccgtgaaggactcctcggtcgacgaacccatggtaacgaagaagaagggatacgcaggcgtctgggaggagtacgtcctcgacctcaccgacaagacggtgaaggcggtctatacccccggatactaccgcgtggagttcgtatccgagggtaacgtgttcttctggtacgatctcgagcccgggaaggagataaccctaccttccagtatcccttccaaggatgcggagatccgttacgtctataccttctccggatgggacggctacaccgacggcatggtcctcggcgacgacgacgtcaccttcaccgccgtgttcgacagcaccgtgagaaagtacgcctacaccgtcgaatatgtggacggagacgggaacgccatagcggacccggtgtgcggtaccgccgactacggctccacggtctatgccgagttcaagggcatagtcggttatatggggccgtcagacatattccgtcagatcgtgatctccgaagacgaatcgaagaacgtcgtcagatatgtctacaccatactccattattttgtgatctactatgtcgacggatatttggtcttcggggattcatacgactacaataccgaggtgacagtccgcgaaacgtatcagatgaccggacacaccgtgacggattggtccaccgacgatgtcgaggtcgtcgacgggaagttcatcctagggacatccgatgtggctttcaatgccgtatctaccgccaacccgtacgatgtcatctacaaggtcgacggtgagacagtattcacggacaccttcggctacggtaccgaggtgaccgtccgcgatgttttcctgaagaccggatacacagttacggaatggtccaccgacgatgccgaagtctcagacggtaagttcgtcctcggggcatccgatgtgaccttctccgccgtctcggccgcgaataagtactcctacactatcgaatatgtggacggcgaaggaaacgccatagcggacccgttgtccggtaccgccgactacggctccacggtcgatgccgaggtcaagaccatcaccggatatgccgcaccgtccgggatatcccacatagcgatctccgaagacgaatcgaagaacgtcgtcacctacgtctacacgatcatcgtctataccataacattcgacgacggcaccgtacagaccgacatcaaatacaccgtgaaggcctcttcggtcgacgaacctccgataacgaagaagaagggctacacaggcgtctgggaggaatacgccctcgacctcaccgacaagacggtgaaggcggtatacaccgccgagtcctatcatgtggagttcatctccgacggtgccgtcttcttcgcatacggccttgaatacgggaaggagataaccctgccctccggcaccccgtccaaggatgctgacgtccgttacgtctacaccttctccggctgggacggttataccgaggacatgaccgtcgacggagacatcacattcgtcgcggtgttcttcaggacggccgccgtcgcggaggacggttccgacctcgcagtgaacgtggacgaggacaatgcggtattctcctccgacaccatctcggacgtcttaagtaaggcggagtccgacccctccgtcaccatgacggtctccgtcggctacggggtcgtcgtcttcgacaacggttccctcagaagcctcggatcctccgaagccaccctggagctgtacgtcttggatccagacgacatgacccagacggtcagggatgtcgtcggcgacaacgtggcgtacagcatatccttcggtcccaacaaggcgttcggcggcatcgtcaccgtgaccgtcccgtatgtactggccgaagccatattttaacctccttactgaaccacgatgggtgaccgtcccgtatgtactggccgaagggaaggacccggacaatctggtcgtatattacgtggcggaagacggggccgtggaggagatcccctgcacctactcggaagggtacgtgacattctccaccgaccacttctcggtctatgcggtgatgtacgaggagtcccatgacgtatcggcggagacggtgctgctggcacttatcgccgccatgatcgtgatgccggcggccgtattcctttctaggaggagggcggccggaaggtccgtctgaatagacgacccatgtggcggtgagtcggtggcgttccaccctcaccgccgtatcatacaggccgggtcccaatgcgttccaccgatgcggggagtgtcgaatcctctacggctaagatgctgtccgtcccatatcgtcaaagagggattcaagactgtgaaggtcgtcagagtagcgaaacacccgacggcacatgatattcccgagagccgccgatcagatgccacttccggccttctctctcggattgccttatcaacaatgcattatccccgcatgtgccagatgcttatggtcccatgagtatggatggttgtataatccaacatctttcaagttattgatagtaccttttttatgggttcaagatatggcagtcccgatagggaattccatggaaatagagcagtggttaggcgcggacaacaaactcgggatagacatttggaacaagaaatactgctacaacggcgagaccttcgagcagtggctcgacagggtctccgagggtgacaaggcggtgaggaagctcatagaggagcagaagttcctcttcggcgggaggatcctcgccaacaggggcctccagaagaccggtctcaaggtcaccttctccaactgctacgtggtacagcctcccgaggattctatcgaatccatcttcgaatgtgccagcaaggccgccaggacgttcagctacggcggcggggtcggaatagacctctccaagctggcacctcgcggcgccaggatcaacaacaccgcctccgagacctcgggtgcggtctccttcacagacctctattccatggtgaccggcctcatcgggcagcacgggaggcgcggagccctcatgctcaccctctcctgcgaacatcccgacctcgaggagttcatggccgtcaagaccgatgtcgacagggtcaccaaggccaacatgtccatccgcgtcaccgacaagttcatggaatgcgtccgcgaccacgagacgttcgtgcagacgttcgtccgtcccgagaccaacgacacggtcaccaagaacctcgacgcctacgccttcttcaagaagctctgctacgccaactgggactatggggagcccggctgcctgtactgggacaggatcagcaagtggaacctcctctcggagttccccgactacgaatacgccggcaccaacccctgcgccgaggagcccctccccgccggaggcagctgtctcctcggcagcatgaacctctccgccttcgtcaagaacggggtcttcgacgaggagggcttcaagaagtccgtgaggatctgcgtcagggcgctcaacgacgtcctcgacgagggcctccccctccaccccctgcaggagcagagggagtccgttaccaactggaggcagatcggactcggcatcatgggtctggccgacatgctgatcaaaatggagatggtctacggtaccaaggaggccatggacttctgccacaggctcggattcataatggccgacaccgccatcagcgaatccgccttgatcgccaaggagaagggcatgtttcccaagtgcgtgatagaccaggtcctcgcctccccctacttccgcgagaacacctccgaggagaccagggagctggtcagacagtacggtctgcgcaactcccagctgctgaccatcgcccccaccgggacgctgtccaccatgctgggtatctccggagggatcgagcccatcttcgccacccacttcgagaggaggaccacctccctctccgaccacgatgaatactacacagtgtacccgccggtggtcaaggactacatcgacaagcaccatctcaaggacgacacccagctgccggcctggttcgtcaccgcccagaacctggattacaagcagcgtctgaacctccaggggacctggcagatgcacatagacgcgagcatcagctccaccgttaacctgcccaaggacttcccggaggccgacgtctacggcctgtacatctacgcctggcagatcggatgcaagggcgtcaccgtcttcagggacggatgcaagcgtctgagcatcctcacccccaaggagaaggaggagaagaagaaacaggaggccgagaagaaggagaccgccgtggagaaggccatcgcccccaacaggggagtggtcaagaccgtcgccgacaacgtcatcgggaagaagaggaagctgatgaccggctgcgggagcctgcactgcaccgcattcttcgaccccaagaccggggatctgatggaagtctatctgaacaaggggtccaccggaggatgcaacaacttcatgatcggcctctccaggatgatctccctcgccgccaggagcggatgcgacgtctactccatagtggaccagctcaagtcatgcggatcctgtccctcgttcgtcgtcaggaccttcaccaagaaggacaccagcaaggggtcctgctgccccatggcggtcggatgggccctcatcgacatgtacgaggagatgcagaggcaggtcaaggggtcgaccctcatcgccccagccgccgatcctacacccaagaagaaggtcctcaacccgtgtcccaagtgcggcgacgagctcaccttccagggcggctgcaacatctgcaagtcctgcggatggaccaagtgcgagtgaaacataagggggtcatggccgggggtcgactcccccggccgtatcccagtcttctacgaaactatatttcagaggtcgtgcggcggtcggtacctgctctccttgagcacgatgcctttctcgaacccgccgcgttccttccttttcctgtcgcggatgcccatcagttccctttcggtgacaccgaggtatgatgcgagtccgaacaacacctccatgacgtccgccagctcctccgggtccctgctctcccggaattcctccgtctcctcgtcgagttttctgtccagatatccgaacagatcctccccggctacggtctccgtcctgcaggtgcctccgttcccgattattatctccggtatcctgtccctgaccagcttgtcgtatcccgtcattccttctccttcccgtagtagcggctctgcttgaaatccatggccctgaacgacagcgcgtcgcggacctccccgatgaactccttcatcatgctgtagtccctgagcctgtcggtaagggagatcagcccgtcgtccttccttctgaaataaagcggttcgcttttgcacaggaaacgtatggggttctcgacggccagtttcacccagtagtcgtccgtcagctcccggtccttcctggtcttgatgccctcgaagtctaccatgttgttgtccctggagtagaattccctgaacgatccggctatctgttccgcagtgggttcgaagaccaccctgtcctcggtgaacatcgacaggagcagggggatcttgtacatcctggacatggaggtgttctccaccatccggatgaacgccagggcgtcctccccgagcagttcggacctgtcggtgtcgaggtctcccatcttcctcaggtatccgatgtagtccttgaacgggttgaccttggggtccaggcggaacagcttccacttctccgggtccatcatggagaacagttcgcatctggagggtgcatgtcccagctcctccctgaccctgaggtactccccgtcgcggatctcggacttcttccggcgggcacccatgcggtcgaacagtcttatgacctccaggtcgaagtctgcgaagcatccgtccgggaggcctttggccatgtccgacatcgtgtgtcctccgcccctcctgcctgtcagcatggacggtatcagctctgcgttgcggtagttgcctatgaagtcgaggacagtgaggaagtccttgccctcggagagtctcagtccccttcccagctgctgcatgaacacggtgggggactcggtgggtctcaggaacatcaccatgtccagggaagggacgtccaccccctcgttgaacatgtccaccgagaagacgacggatatcctcccctcctccagggctcttttcgcctcttcgcggtccgtaccgcccctcgaggagaccgccgcactgtctatcccgttctttacgaagaacgacgccatgaactccgcatggtctatggacgagcagaaccccatgcagcgtctggagccgtatttcaggtagttgtccaggatcagcctcgccctgacctcgttggccagggccctcgtgagctcgtcctccctgtacctcccgttcacataggttatccgggagtagtccgtcccgccgtcgtatatcccgtaatatctgaacctgcataggtactgccgctctatggcctccctgaggtctatctcgtacaccacgttgtagtcgcacagcacgaagacgtccttgttatccatcctctcgggtgtcgcggtgaggccgaggaggaacttggggcggaagtggtcgatgaccttcctgtaggagtcggcggcggcatggtggaactcgtcgatgacgatgtagtcgaaatgatccgcaggtattctatcgaggttgttgtcgcgggagagggtctggacggtggcgaaggtcatgtccttctctatgtcgaactcccctccgcagcacattccggaggaatctcctttcctgaccgccgagaacgtctcccgcgcctgcctcagtatgtcctccgtgtgggccacgaacaggaccttcctgtatccgcatgagtcgaaggcggcgaggacggtcttgccggtcccggtggcggccaccaccagcgccttgtccattccggattcgcgggtcatcccgagattgaacagcgcctccacctggacgtcgttcttctcgaagacccttcccggggcctcctgtctgacgggaaggcggggagggacccttctcagacggtattcctcgatggcctcgtccgtcgcctcgtaggacatgtccacgtcggtgaacagcttctcgaactcctcgcggaagcggtcgaactcacgggggctctccgagcggaggatcttgtagttccattcgaccccgtcgaccaatgcggaccgggagaggttggacgaacctatgaagagacatcccgaatcccccttgtagaagaagtacgccttggggtggaaggagttggtacccttgtagaacctgatgtcgatgttctccccgcacacgtccttgagcatcctgaccgcggacgggtcggtgatgtccaggtacgtcccggtcaggaaccttatcttcacgcctttggccacggccttgcggatgcccgggagtatctcgttcacccccgtcaccttggtgaacgaggtgattatgtctatgcgttcggcacccgatatagcctcgttcaggggatcgagcagaggtgcgtcgtatcccgtgaacacccttgaatcggagatcacggcgagggattgccctattccgattaatatcttacacagggccttccctgccgggggatatccggtccctcctccgtgagtccgcaggtcagaatccgaagttcgtgcttatcaggaacaccagcatcgacacgggcagcatcatgcctatcctgcgtgccacgttctccgtcctcgcattcccctccaggaaggatacgagggcggctatcatgacgcacagttcggcgaggtataccatcagcaccgcggtcgtcccggagaaccccccgtcgccggatatggcggtgaggggcgtcagcatcgatgtgctcagtcccagcacgagaggggcgaacaccgccgccgtggagaacatcgtatccatcattccgcgcaagtcggaccttatacccctgcggacggtttcctggtccttcagctgtctgccgacagacagtgccagtctcccggcatcgcggaggtccttgaggccggcgtcgtatatcccgcacaccgtgtccgcaaccgtcggcgatgtcggggcgatggcggcggttatggccgagcgtacgtcccccctgcatatggacagttccctcctcagggcctccgccaccggaccgcattcctccctggcacatatggacccggtgagggcgtcctcgaacccctcccctgcgatgagcctgttccccatctcgaagacggcgtcctccagggccccggccctcctccgtctggccgtctcccttttgtatcccgggtacacgctgatgaagagtatagccccgcctgcggcgcacccgatgcatcccgcggtcacgggtccggcccctgcggcggcaagtaccagatacaccggtgccgccgatgcgaggggcaacaggtagccgtagttgttccctgtcttcccggagggcatgaacgggttcttctccctgatggaggccatgacggccaccacgatggcggggatgaggacgagcgtgatgacggccagctgacccatccctatggattgcgacccgaagatcccgctgatgctaagcatggggaggatggacatcaggatcattggcatcattatccccactccgaacacggccatgcagggggcgttgagggaggaactgtacgccttcccggcctccctgaggccggagagggcgatctcggaggcgtcgcggagggtcctctccctctcgccggcctcgcgggcctccgccgcggacatcaccatatggatggccatggagtatgcggcggcaccgtcgcgcagctgtgacagctccttggtgagggatgatttcatgtcggcctcgatgcgggtgtcggccctgtccaccacacggcggaacatctccgcggacagggcgggaccgctgtccgctacattgcggacggcgacgtccagcgaacctccgttcccgataacgacggtcatcatcccgaccacctccggtccctcgttcaggaggggcgggacctttatgtcccgggccgtccggacctttttttcagtacggcgtccggtcctgtgtacgctctcctggatcatatgtcgtcacccagtcccttgccggtctcggtgcggaccttcatcttgaaggtcatcaggatctcctccgcggaccttcccgtatggcgggccatatgttcgttggccgccaccacccactccgggctgtagaactcctcgtatctctgggccaattgtgccagatattccctcagaagccctctggcctttatctcctcccgggcctcctcctcggacatggaagaggacgacagggcccttctcatgaccggcaccgagaagtccaacctgttcccggacatgtccacgaactcccctatgcggtcggatgtggacacgacctcgttgaccctcctggcctgcgcccccgtcctcctgtcgcggaacgtccctatggtgaccaggatgtcggtggccatgaacgcctccgccgagatgcccatgtcgtgcacgaccctctcgaagacggtcttggcggaatccccgtggattgtgcccatgatagagcttcccgcacgtcccgtgcgcatactctgatagagggtcttcgcctcctcccctctgacctccccgaggattatggcggactcgccgagtctgagggagaccctgagcgcctcgttggaccgggacaggtcgttcccgtccatcctgtcgtccacgagcatggattggatcttgtaccccatcttcctcatgctctccccggggagctcgatggtatcctctatggtcagtatacgctgggagagggggaattcgaacatcagcgccgacagcatggagctcttccccgcacccctcgccccgcatatgaggaaggtggcgcggttctgcacgaggaatgacagcagtcctgcggtggccgcatcgaccgtcccgttggctatgagcctcgtgagagtccacgggttggaggagtgtttcctgatggccaccgcatcgccgctcgggctcatggggtatccgacgacggtggccctcgcatcgtgggccttcatgtcggtctccaggaccgggctggactcgcagaacgggaggccgctctccctcttgagtacgtttatcaggttgtccacctccctcctgtccaccaccaggttggtcctgcagcggacatgggagttgctctcgcccacccccgacatggtcacatgtatgcggttcctgtcgcacggtgcatccacgtagatatcctccagtttcgggtcggacaggaggatgtcgaagacccccaggccgacggagtagcggtatacgatgtcgcacatcctctccatctgctcctccatggcgttcacgttcccgccgcaggcgatcatgatggcgtcggacgaggcgtcgatgaagtccctcgccacggaggtgacgaactgacggtccgtcctgcccccgtgctcgcggaaagacctcctcaccgcctcgatcgcatcctctatgatgcagttgaccgcatccggactcgtgtattccgaaggggtgaggttgtactccgtctccccgtccgcggccgtcccgacgaccacgtggccgttgggggtgtcgtattccgccagtacgtccagttctcccacgctgcctatgagccagcagtcggcgtaggacggtttggtcctcacattgccggagagtatcctgcggtagtcctccatgaacgtgctgcgggatatcaccggacgggacctggggacgctgttgttcccggctacgaacttccttccctccgcatccccgcggaatctgtccgtctgggtcatcccccatataggggccgtcttctccgcacgcttggcgaacatcaggctacccccttcccagaggcgatcctcgcggccttctccctcaccctctccatgttgtcctccgccatcctgagggcggagtgggtcctctggaggcaggccgcgcattccggcccgtcccctgccaaactgtagaggcggtcgcaggccgccgcgaatgacgggtccgggaagtcggcccatgcatcccccatgaccctcacgggagaacgcatgcaggcggaacatctcctggtaccgttggtggggagggtggccctcctcaactgtgccagatcgcataggacctccgccgcctgtcccgatatgtccgtgtccttcccggccttgagctgtatcctgtccgagacgccctcagtggatatggctgaggttatgcatcttatgcacatgggggaccccgcatcggggaactggtcgcagcccctgcagctgaccacgaggttcccggacctgtccatgcatgccgtcccgggggcggggccgtcggtcttcttcgaactcttcttcggctgtctgatatccttcatgcttccgacgacgaacggcggaggatttaatggcccaccgttacatgtagtgtttactcctcggcaaacgtttataagcagatagtcgtggagaagggtatggagatactctcgccggccggttcccccgaggggctggtcgcttctgtaaaaggcggatgcgacgccgtgtatctgggaggcaagtctttcggggcgagggctttctcgaacaatttcacggacaagcagatcgagggcgccgtcaactacgcgcacgacaacggtgtgaaggtctacgtcaccgtgaacaccctcatcaaggattcggagatggacgacgccgtctcgttcgtccgtttcctggcggacataggtgcggacgcggtcctcgtgcaggacctcggtctcctgaagtccctgcactcggtggatataaagaagcacgcatcgacccagatggggatatgctcccgcgaggggctagaatggtgtgcgaggaacgggatatcccgtgcggtcctgaaccgtgaacttacgttcgaggagctggaggacatcgtgagggactcccccgtggagacggaggtcttcgtgcagggggccctgtgctactgcctctccggaggatgcctcttctcctccctcgtcggcgggaggagcgggaacaggggacagtgcgcccagccctgcaggaagaagtacaccatggacggggagacgtccttcaggctcagcagcgcagacctctacggggtggactggataaagaaactggattccataggggtcacctccgcgaagatcgaggggaggatgaggagccaggcgtacgcctacctcgcatccaaggtgtattcgtcggtaaacaggggtgcggacccgtcggagtacggggaggacctcgaccttctgaagaccgtgttcaacagaggctactgcgacggatatctgggaggggtggtctcccccgtgcagatgaagtatgcggacaaccgcgggtaccgcctcggcagggccactttcaagaagaggaagttcgacacatccgagctggacgaggaggtcaacgtccgcgatgggatcagcatctacgacggggatgtcaaggtgggcggcttcaagctcagctccgtggggaagacggcctcccccttcgacataccggacgggacatacgacgtgtacaggacctacgacccccgtatagacatcataaagaacatggtcggggacgttccccggttcgacggtcagacggagaggaggcccgtccattcccgtttgaaggaggtcgtgaggccgaagagggacctgcctgagatgtccttctacgtcggttccgtcaggaacctcgaggcggtcctcccctatgcgcacaggatatactacgaggagtgcgactcccttcccgaggcccaggagatatgcgacggtgccggcaaggagatcgtgacgatcgctcccaggttcgacccgtcctggaggccggacacctcgagacctttcatggtacacacccccggacagtacatcccccgcggggacgagcgcatatatgccagctacaacatgaacgtgttcaactcccgtgtgagcatgcctttctaccagaccaccctctccacggagctgtcggatcaggagattgaatatctggcacatcaccaccccgggagactggaggtcatggtgttcggcaggacggagctcatgtgcacccgcgaccccggtctgaagaacggcatactggaggacgagaagggatacaggttcccggtctacagggactgccacggtctggcacatgtactcaactccaccgacctaatgcttctgccgtacctcaggcagctggggtccttcggcatagactccgtgggcatagacgtgaggaagcgtcccgagaggatcgccgcggcggtggccaaggccttcgccgggaacaacgtgaaggcgaagctcgacctcaccggcctgtgcggcgggataaactacggggcgtacctgaggggtactgactgactgcatgtaataggctggttttaaaggcctccgatgccaccccctccccatgataggcgataggagaggggacatagggttcatggaggccatggtctcggccgtgtccgtatgcatcgtgctgacgtgcttcgtcgcattcttcgcatacagtatggccgacgaccgtgtggatttcccggatttcgactggaacgctgtatcgtcggtctcactggacggcggggagtattcggacgagggggtgggaccctcggtggcgggacagatctcgcgcaacggatggaacggggtcgtcctgacctgcagcggcaacgggacaggacagccttccgccgtatggtcgttcgggtcccccgaaggggatgtgtccagttcgcgcatcctgcgttcggtgccgtccgacgacggccgtatggtaccgacggtgttcgaggtgacggtatggtactgaaccgcaaagggttcacaggcgtcgtcgacgccatgttcttcatagccctcatcgggatcgccgtggccgttttggccgggggcatggcgcaggaagggtatgtgccagactacgatgcttcgtccttctgcgacgaggcgttccgttccaaggtgacgtgtacggagttcgggatggacatagaggacggacgtatacatcccgtcgcggatctgaccgccgcctccgtggccgcgggggacggttcggcggagacgtatttcgggaggctgctggacggggtgttcgggaggccgggggcctacctcatgacgatcggtttcggcggggactcggtgtcggtcggttccggaggggggacggagacgtacggcttctcgtccgactatacatcctgcttcggtgtcgtacatgtggagctgttcctatactaagtgataaatcggacgaacaggatggagggtatcgtgccatttgctaaggtcaacgggatcgagatgtactacgagcgtgtcggacagggcgagcccatcgtcctgataaccgggttggccggagacgtttctttctggaacaagaccgtgcccatgctgtccgacaggttcgacgtcataacggtggacaaccgcggagcgggaaggacacgttgttccgggaccttcgggatagaggacatggcggacgacgtcatcgccctgttggatcatctgggtatattcaagtccaacatactcgggtggtcgatggggtcccatatcgccctggacctcgcggcgaggtatccggacagggtgaggaccctgacgatcgtggcatgttatctgtaccgtcccgccaggtcggcctacatactggaatatctggcggacgggtatgcggacggtaccgtctccggggggacggtggccaaggtcctcaacgtcctgctcaggaactcggggttcttcgaggaagcggagaggaagggccgtactatcagggagatccaaccccccgacccgacaggtttcaagaaccagatgcgtgcggtgaacggttacgatgcggagaaggatgcccgttccatacgcgtgcctacgctctccgtccacggtctcgaggatataatgacagagccttccgccggggacgagatctcttctgtgataaagggatgcgagaagatacgcataccgggggagggacatgtcctccgcccggaatcgtatataccttacgtgatggtcttcatcaggcatcattgagacggccggcgcggaccttgcggccctcctcgaccttctccgcgatggtggaccttatctccttggtgcacggccacttctcatccatgtagccgaccatgtcgagtatgtccgcatccggattcgtaagtgccagatagacgcgggacacgaacatggagaccagataggggaagtcgtcgcagatctccggacggtcctcccatatggtgcatctcctgtccttccccaggaacgggcagggtccgtcctccttcttgtttatgaggatcctcccgtccgacgtctggtagacgtaccgggtcatgaaggtgtacaggtccacgccggcggcggtggacacgcggtccacctcctccggacgtattatgatgttgggctgatggcagcatttcccgcacatctcgcaggggaacatcccgcggtaggacatgcatatgtcgtatgccaagtccaggtccttctccatctccggggagatcttcgcgagtccctcgagctggtatttccctctgtacaatgccatatcagagaccacttatcacgtcggcgtagccgaggatgaacccgatcacggacaggaggagcccgagcgccgctatgtagacgaacggcatcttgatctcgccgatctgcacgcgcttcatggcacggctcatggagaatccgcccaggaagagtccgatggctccgaaaacgacggccgcccagctgttcaggaatatggccacggcggatatcgctccgagggctaccgccgcgatgcacagatgtttcacgggcaccggcgccctcttgggctcgggtgcgaaatcgtctaggttcatgtgacaccgtcccgaggatatgcgtgccctattaaaaggatgcttttccgatgacgcactccaagcgtctgcggacggtcccgaagcgggtgggctcgtccacgtgctccaccgatatcacgtcctccccgcggaacatcccccttatgtcgtcctccgagaagtatctgtagaggatcccgttcctgacgtcctccttcctcccgccggagcgcatgtccccctccgcgaagcagcggatgcatatcctccctccggggacggtcacgcggagcgcctccgagaccgccttcccgaggtcctccgccggcacgtgctcgaacacgtgcacggccacgacggcttcgaacgagccgtcggggaacgggaggtcccggcagtcggcggtcacgaactccgcacgatgtcccagcagtctgatgcaggactccacggccgcctcggagaagtcagccccggtgacctcgcatcccctctccagaagggcctcggaggtcttcccgttgccgcaccccaggtccaggaccctggtccccggacctatgccagtccatgatatgtcggccacgcccctccacggtctgccctgggaggagtagagtctgtcccaggcttccttctgggtatcgggatccatgtccgtccgaatcaattataataatatgaaagcattgcgaaggccagtacggggaactgatcatgttctggaaccctaggatcgagacaatgccatacgaggagctcaagcagctccaataccacgaactgaaacaacttgttaacaacctctacagcttcaacaagttctaccacgacaggatgagggaggccaacgtatcccccctcgacatcaactgtctggacgatatcaggaaactgcccttcatgtacaagcaggacctccgcgacaactatcccgacaagatgttcaccgcccccaagaacgagatcgtcaggtaccatgtgtcctccggcacctccgggaagccgaccctcgtggcgtacacccgccacgacctcgactattggaccgaggccctcgccaggtccttcacctccgccggcatcgggcccggcgacataatgcaggtgtcctacgggtacggactcttcaccggaggtctcggggcccactacggggccgagaaggtcggtgcgacagtcctccccgcctccaccgggaacacgcagagacagctggagatgatgcaggacctcggcgtcaccgtcatcgcctgcaccccctcctatctgacccacctctgcaccaccgccagggagatgggcatcgactggaagagggacatgaagctcaagaaggccatcctcggtgccgaaccctggtccgagtccatgaggaccaggctccagaatgagatgggtatcaaatgctacgacatctacgggacctccgagcaggcgggacccatgttcagcgagtgcgaggcccagaagggcgcccacatctgcggcgacctgatgctggtcgagatcctcgaccgcgagaccggggagcccctggagcccgggaacgagggcgagatggtcgtgaccatgctgcagaaggaggccatgcccatgatccgttacaagatgaaggacatcacccacctcgacgtcgagccctgcgagtgcggcaggacctcgccgaggatcgggaggatcaccggcagggccgacgacatgctcatcatcaggggtatcaacgttttcccgtcgcagatcgagtacaccctgatgaggatcccgcaggtcggggagcagtacatgatctacgtgaccagggaaggggacctcgacaggatgcagctccaggtcgagatcaggcccgaggcgttcagcgacaaggtcgaggacatggtggccctgcgcgcccacatagagagcgaactgaagaaatatctcaacgtcgctgtggaagtggaactgaaggcccccggggagctccccaggttcgacgggaaggccaagagggtaatcgacaagagggtgttttgaatggacgagtgcataatcacacagctttctatcttcgttaacaacgaacccggcaggctggccgccgtggccaagacgctggaggactgcaaggtcaacatgaaggcctgcaacctggccgaatccaccgagttcggcatactgagggccatcgtggacgaccccgacgcggccgccgagaggctgaccgccaagggcgtcatcgtgaagaagaccgagctcgtcggggtcaagatctccgacgtccccgggtccctctacagacccgcggccgccctcggggaggccggtgtcaacatcgagtatggatacgccttcaccggcaaggacgtcgaaggcctcctgatgagggtggacgaccccgccaaggcggtggacgtcctgaagaaggcgggcctcgagctcatcaagggatcggagatctgaatggggaacctcaacgtcgcagcggtaggggcgcccggcctcgccgcggatatcggcaagaaagggaccgtgtcggacatgaccttctacgaggtcaaggagggttccgactccataacgctcatagagccgtcgaaatacccggacaagctgtcgtccctgttctacgccaccgagatgtcggagttcgtcatcctcacggtcgacaagatcgactccttcctgggggagaccatcgtcatggtcgactcgcagaagaggtccaaggggtggatcgtcctcaggaactacatccagccggagcagctgaaacccctcatcgcagggacctgcctggagggctacgagttcgtggaggaggaccccacggccatgaggatcgccctcatagacatggcgaaggcggagaagaggacggccggggacgggacgtgcgggtcctgcccggtggacagccacttcaacgtcaagggcgtggggaccgtcgtcctcgggtccgtggcggacgggtacttcaaggtccacgacaagatgaccgtttggcccgtgaagaaggaggtcgtcctccgttccatccagaagcacgacatcgatgcccaggacggggtcaagggggaccatgtgggtctcgccctcaaaggcatcgagagcgacgagctcgacagggggttcgtgtgctccaccgacccctccatcaagatgacccagaaggtcacggggaaggtcacctacaacaagtactaccgcggcgagctgaaggacggcatgatggtccatgtgggccattggatgcagatggtcccggcccgcatcgagaaggcgtccggcaaggatgccgacgtggagatgtcattcgacggacagatcatccacaaaccgggggacgaaggcgtcgtgatgtacctcgagggcggcaagctcagggtcatcgggacgatagtccttccgtgaatacgtttttcatgacgatccctccgcggcatccgccgcggaggtgcatcgtccgacggcgatgtccgacaccgggacgtccccgtatggggatgtatatcccatcgcaccgccgccgcacaggtgcggccggcatgagtcccttctatcgcgatagtgattacatggtgtcatagggacggggacgtaccgccttcccgtgatgctcaatttatatcgaggaccgattacacccggatacggagggacggacatcagggactggttcgggatggaacgcgactcgaagctcatcgagtaccctaacagggaggagtgggacggcctctataccacggtctcatgcaggcgcgccctctccccctccggtctcccggggatacagtacgccctcaacccatacggaggctgcgagcacggctgtatatactgctacgcccccgaggtcacccatgtccaatggggaggttggcgcgtggtcagggtcaaggtgaacatagccgaccgtctggtacaggagctccccggactaaccggcaccatcgggatcggcaccgtcaccgacccctaccagggggccgaggcccgcttcatgctcacccgcaggtgcctggagatcctgaaggagagggggtacagggtgcacatccataccaaatccgacctggttctgagggacctcgacctcctgtcttccatggaaggggaggtgggggtgacggtcaccggtctcgacgagaggaggtccaagatgctggagcccggggcgccgctcccggaggcacgcctgcgcgccctgagggagctttccgccgcaggcgtggatgcttatgccctcatagggcccgtcctgaaccatctggagggtcatgaggacgaattctgcgacgcgatcgcctccacaggggtgaggagggcggtcctggaccgtctcaatccccgtccggaactgtccaagaggacggaccggatgcatgtccggggttcggatgtggcactggaaaatataagaaccatgctggcatccagaggtctgaccgtggaggacgccttccgagaggaggccagacgtcattccccgtgtcggttgtaaacctgtggttacacagatatgtttttatagaagcgcataataactatacctcgtaaaataggtgatatatcctatgtacggaaacagcaaccagcctatcatcgttctcaaagaggggacccagaggagcaaggacaaagaggcgcagttcagcaacatcgacgccgcgaaagccgtagcggactccgtaaggtccaccctcggacccaaaggaatggacaaaatgatggtcaactccatcggcgatgtcgtcatcaccaacgacggtgtcaccatcctcaaggagctggacgtccagcaccccgccgccaagatggtcgtcgaggtcgccaagacccaggacaccgagtgcggagacgggaccaccacctccgtcgtcctcgcaggagagctcctcaagcagtccgaggacctcatcaacgccaacgtccaccccaccgtcatcaccaacggatacaacatggcggccgccgaggccgtcaagattctcaacgagatcgcggtcgacgccaagaacgacaagatgctcaagaccgtgtccgacacctccctcaccggaaaggacgtcggggacgacagcgacctgagccacctgtccgacatcatcgtcaaagcggcgaagttcgtcgccgacgaggacggaagggtcgacaccaagaacatccgcatcaccaagaaggtcggaggcgtcatcgccgacacctacctcgtgcagggagtcgtcatcgacaaggaactcgtgcactccaggatgcccaagatctccaaggacgccaagatcgccgtcttcaactgcggcctcgaggtcaagaagaccgagatcgacgcccagatccagatcaccgacccctcccgcatgaacgacttcctcgcagaggaggaggccggtatgaagaggatggtcgaccacatcaaggagaccggagccaccgtcgtcttcacctccaaggccatcgacgagctcgtgcagcactacctgaccaaggcgggaatcatgggatacaggaggctcaaggagtccgacatcgagtccatcgccaaggccaccggcgccaccatctgcggcgaggtcaacgagctgaccgagaaggacctcggaaccgccggatgcgtcgaggagaagcgcgtcggagaggacggcatggccttcatcaccggctgcaagaaccccaaggcggtcaccatcttcatccgcggcggtaccgagcacgtcatcgaggaggtcgagagggccatcaacgacgccgtacgcaccgtcggtatcaccctcgaggacggaaaggtcgtcgccggtgccggagcacccgagatcgagctcggcatcaggctcgccaagttcgccgcatccgtcggcggaagggagcagctcgccatcgagaagttcgccaaggccatggaggtcatcccctggaccctcgccgagaacgccggactcgaccagatcgacgtcatcatcaagatgaagtccgcccacgagaacaacaaggacggcaagtacttcggtatcgacctcgactccggagagcccgtcaacatgctcgacaagaacgtcatcgagcccctcagggtcaagacccaggcggtcaactccgccaccgaggtcgccaacatgatcctcaggatcgacgacgtcatcgccgcccgcagggcacccccggcgcctccccagggaggagcacccggaggaatgccccccggaatgatgtgatccaaacccttccaggggcataaggccccttccctcccggggacgtctccatccgtccccgggttccttttctactgatgtttcgaaaacggttatatcccacgcacgccatgtgccagcatggcaagtacccagaccgtgtgtcctaagtgcggaaaggacgtcgatttcgatagcgctctcgtgcgctgctactgtcccggatgcggacgcatgctgatcagggcggacctgtccgagaagccgtccgccgaggaggcctgcgccctgctgtcctccggagaggacctcataggcaggaaggaatatgcggaggcgttctccgcatgggcctcggccgtcggggccgcatcgtccaaggacctggccgtctggagggagaagatccccggactcatagcatcgaacgtcacgggggacctcatgctcctgcagcccgaggtgcaggacggatacgtggacgtctgcgaggcgttcaggaggaaagggttcgacctggccgggaagacggtggattccgccatggagacccccctgaccggtaaattcaacgcggatatgaccaatttcttcgccgtcatatcgctgcagggagtggccatagagtatgcgaaggatacggaggacatgtacaacaagtgccgctccgtgcaggaccgttactacgattgccgtgcggccctgaaggacggtgaggggaagactctcttcgcgtccaagtccatgtacaacgacgccatcaaacccttcgtggtgctgggcggtctggtcaattctaagacccgccgcatgacccaggcgaagaaggacgccctcaacaagctgtgtgcggagacggaactgcctccggagatacgcggaatggtcatcgacgccgtcaactggcaggtaaggaggatggccaccacttccctgaaggagaactcgaagtacaagtccaacatgaagaaggatctgaggacgttcatcgaggggtatttcggaaggttcgattactgagattcataagatgatcgtcggactgtatgccgatcgcgaatcgagtcatgtgaaatacgtacggaggatccacctgccgtcatccgttaaattgaatctgcgtctgtgctcatcgcgttccacccatcccagattgatccatttctgcacaaagtcccgatggaaccatacgacgtcgtattgcttggaatattcctctgatttcgattcgccccttagccacagtccttctgatttgataagcgatatcgcttcccgggttttgcagttgcagttgacatatgctctgaggccgcggacaaggatctcgtcgggatgcggtatcgaaaccttgaccatcggagacggatctgtcacagaacgcgataatccgacagggcggtctccgtcatagtacagttttttcacattttcaagatcaacggtgtattctttcgtgctgaccgtgaaaggaatggatttcggatacatcatggatacgatggttgccgcagagatgtattccgacgatcccgatgagagattcacatatatgtcggaatcaggatgttcggaatactcggatccgaggatcgattccacttcgcggataacatctggaaaattgctgacatttacattatgttccacgacttcggcacctgatgatgatatctgctccgaagtctcttcgaagaagccggcatatatggaacctctttcggattccggatcgcggatgtaatgcagcagatgcactgtatgtaccccgtaataatggaccggttccgatattttcaccgtttcaaatgtcacgcaggcaaccataatgttcctgcgtccgccggacttcatgttggctgcatgtgcgttcttatatataattgcaaaattacattaataacaatattatgttataaaaataaataaaacatttggtatacaaaattatatatgcacacaggcggattacttagcatggatgccaaggagtttaccggacagtaccccctttcgaagactctgcgttttgaactgagaccgataggcagaacgtgggacaatctcgaagcatcggggtatcttgcggaggacagacaccgtgcagaatgctatcccagggcaaaagagctcttggacgacaaccatcgtgcattcctcaaccgtgtcctgcctcagatcgatatggattggcacccgatcgcagaggcattctgcaaagtccacaagaatccgggaaacaaggaattggctcaggattacaatcttcagctgtccaaacgcagaaaggagatttcggcctatctgcaggatgcggacggctataaaggtctgtttgccaaacctgcattggatgaagcaatgaagatcgcgaaagaaaacggaaatgaatcggacatagaggttcttgaggcattcaacggtttctccgtatacttcaccggatatcatgagagcagggagaacatctattcggacgaggatatggtgtcggtagcttatcgcatcaccgaagacaatttcccgagattcgtttccaatgcgcttatattcgataagctgaatgagtcgcaccccgatataatctcggaagtatccggaaatctgggcgtagacgacatcggaaaatattttgatgtgtctaactacaataatttcctgtcgcaggccggtatagatgactacaatcacatcatcggcggccatacgacggaggacggtctgatccaggcattcaatgttgttctgaatctcaggcatcagaaagaccccggattcgaaaaaatccaattcaaacagctgtacaaacagatactcagcgtccgtacatccaaatcctatatcccgaaacagttcgataattcgaaggagatggtggactgcatctgcgactatgtgtccaagatcgaaaaatccgaaacggtcgagagagcattgaagctggtaaggaacatatcttcttttgatttgcgcggaatattcgtaaacaagaagaatctccgcattctttccaacaaactgattggtgattgggacgcgatcgaaaccgcgctgatgcactcctcctcttcggaaaatgataagaaatccgtctacgacagcgccgaggcatttacgctggatgatatcttttcgtccgttaaaaaattctcagatgcatctgcagaggatatcggaaaccgggcggaggacatatgcagagtcatatctgagaccgctccgttcataaacgatctgagggctgtcgatttggacagtttgaatgacgacggttacgaggcggcggtttccaagataagggaatctctggaaccatatatggatctgtttcatgaactggagatattctccgtaggcgatgaattcccgaaatgtgcagctttctacagtgaacttgaagaagtctccgaacagctaatcgagattataccgttattcaacaaggcccgttcgttctgtacgcgcaagagatacagtacggacaagataaaggtcaatttgaaattcccgacactcgccgacggatgggatctcaacaaagaacgcgacaacaaagccgcaatactcaggaaagacggaaagtactacctggccatactggatatgaagaaagatctttcttcgatcagaacttcggatgaagacgaatccagttttgagaaaatggagtacaagcttcttccgagtccggtaaagatgctgccaaagatcttcgtaaaatcgaaggcggccaaggagaagtacggtctgaccgaccgtatgctggagtgctacgataaagggatgcacaagagcggcagtgcattcgatctcggattttgtcacgaattgatcgattactacaagaggtgcatcgcagaatatcccggctgggacgtcttcgatttcaagttcagggaaacatcggattatggcagcatgaaggagttcaatgaggatgttgcaggggccggatactatatgtccctcagaaagatcccttgttcggaggtctacaggcttcttgatgagaaatcgatatatcttttccagatctacaacaaagattattcggaaaacgctcatgggaataagaacatgcataccatgtattgggaagggctcttttccccccagaatctggaatcccctgtgtttaaactcagcggcggtgcggagcttttcttccgtaaatcctccatacccaatgacgccaaaacggtccatccgaagggaagcgtcctggttccgcgcaatgatgtaaacggccgcaggatacctgacagcatatatcgggagctcaccagatatttcaaccgcggagattgccgcataagcgacgaggcaaagagttatctggacaaggtgaaaaccaagaaagctgaccacgatatcgtgaaagacaggaggttcacggtggacaagatgatgttccacgtccctatcgccatgaatttcaaagcgatttcgaagccgaatctcaataaaaaggtgattgacggcataatcgacgaccaagatctgaagatcatcggcatagaccgcggagagcgcaacctcatctacgtaaccatggtggatcgcaaagggaacatcctctatcaggatagcctcaatattctgaacggatacgattaccgtaaggccctcgacgtccgcgaatatgacaataaagaggctcggaggaactggacgaaggtcgaaggcatccgtaagatgaaagaggggtatctgtcgcttgcagtcagcaaattggcagatatgatcatagagaacaatgcgattatcgtcatggaggatctcaatcacggattcaaggcagggcgttcgaagatagagaaacaggtctatcagaagttcgaatccatgctcataaacaaactcggttacatggtcctcaaggataagtctatcgatcagagcggcggagctctccacggataccagcttgccaaccatgtgacaacattggcatctgtaggtaaacaatgtggagtgatattctacatccctgctgcatttacatccaagatagatccgacaacaggatttgcagatctgttcgccctcagcaatgttaaaaacgtggcatctatgagagaatttttctccaagatgaagtctgtaatctatgataaggcggagggaaaattcgcatttaccttcgactatcttgattataatgtgaaatccgagtgcggaaggaccctttggaccgtgtatacggtcggagagagattcacatacagcagggtcaatagagaatatgtcagaaaagttccgacagacataatctacgacgcattgcaaaaggcaggaatatctgttgaaggggatctcagggacaggattgctgaatcggatggcgacactctgaagagcatattctatgcattcaagtatgcattggatatgagagtagagaaccgcgaagaggattacatacagtctcctgtcaaaaatgcctccggagaattcttctgttccaagaacgcaggcaaatcgctccctcaggattccgatgcgaacggtgcatacaatatcgcactcaaggggatcctgcagctacgtatgctttccgagcagtatgatccgaatgcagagagcatacggttgccactgataaccaacaaggcctggctgacctttatgcagtccggtatgaagacatggaagaactgatacgaatctccaacatcaacgatttcttattctgtcccgtatccatctacttccacggtttgatggacggggcagaccgtacaatgatacaatcggagtatcagataaacggaactgccgcgcacaggagtgtggatgacggcacatatacgacccatcacgatacgctcctgggtatcgaagtctgcagcgtaaagtatgggatcattggtaaaatcgatcaattcaacattttaacaggtgtactgacagaaaggaaaaagcacgtcacggcagtctatcccggatatatcatgcagctgtacggccaatatttcggtatggtcgaagccggatatgaggtaaaatcgcttcgcattcacagcatggatgacaataagaattacccgattccgcaccctgatgaatctcccgagaccgttgccgagtttgaaaggatacttgacgaaatgcactccttcgatatttccggatatatacagaccaacgaggcgaagtgcagacgctgtatctatgagccgatgtgtgcgaatggaggatgctatgatgacaaaacctgattttgaaaagaaacagatcgtattcgcatttacatgcgacggcgagaaggtctcattcagaaatgacaatctggtggtgaccgatgccgatggagagatcgtacatcaatccacctgttatcgcatattcgctcttttcatcgtaggccatataacgatcacgtccggcataatcgagaagtccagaaaattctgttttccgatatatctgatgaccccgtctttcagggtcatcgatataattgggcataggacagagggcaacacccgtctcagggagcttcaatacaagtatgacggtttggaaatcgccaagaaactgatactcaataaaatagggaatcagtgcgacactttatctctccagaggacaaatgactgggccatccgtgaaacataggcttccctttccaagatcatgtcctccgtgagagagtattctggcgatgtaaggggccttatgggattggagggcaatgccgcaaggatctattttgatcagaactttgataatgtcaagtggaacggcaggaggccgagggtcaaggacaatgcggtgaatgcggtacttgatataggatacaccctgttgttcaatttcatagattcgatgcttacgctatatggttttgatacataccgcggtgtgctgcataccgaattctatcttcgtaagtcgctgacctgcgatcttgtcgaaccattcaggccgttggtggattggcaggtgagaaaagctctgaatctgggacagattaaggaggaacacttcaacatatccaacgggaggtatcttctggatataagatataataaagactatgtgaagtttttaatgaagccgataatggacaggaagacggatatatttctctattttcagaaatattaccgtttgttcatgaaagatatgtgtgcacaggatatgccttatttccagatgctgaaaacatgatactcataagctatgacatatcagataccaagctgcgtacaaaatttatgaaatacatactgaggtttggcaacagggtgcagatgtccgtatatgaaatagataattcatcacgtgtgttaaaaaatataatggcggacatagagaatgaattcatgccgaagttttcggaagcagacagtattttgataatgaacctttctgcatcctcggaggtaatcaggatgggtcatgcggtccacgatgagagcgatctgctgatcgtttgacaaacctccgtcttcttttcagcacgatgtccgaatctgtatatatatgatgaaaaaaacgtttatttatgatatataacattgatctaacgcgttaaaccgattaaaatgggccttgtacgaactatcgggtctaaaactcattcagaatttctactagtgtagatgaatacgcatttatctgcctcctgtaagtctaaaactcattcagaatttctactagtgtagattccaacttgggcattgtgttacatgttgtctaaaactcattcagaatttctactagtgtagataccctcattctgccgacccataatccggtctaaaactcattcagaatttctactagtgtagatatcgcgagactaaatccgagtctccatagtctaaaactcattcagaatttctactagtgtagatacctgggggatgttattgacaccatacgtctaaaactcattcagaatttctactagtgtagatacgcacccaccttctcgacgcggatgtctaaaactcattcagaatttctactagtgtagataaggactggttggagagcctgcattggtctaaaa

SEQ ID NO: 14 - DNA, 17 bp, Artificial Sequence
  Sense primer mttB
gcacttccaccacatcg

SEQ ID NO: 15 - DNA, 17 bp, Artificial Sequence
  Antisense primer mttB
agctgrgacagracgat

SEQ ID NO: 16 - DNA, 20 bp, Artificial Sequence
  Primer MxF (sense)
ggggtaggggtaaaatcctg

SEQ ID NO: 17 - DNA, 20 bp, Artificial Sequence
  Primer MxR (antisense)
cggggtatctaatcccgttt

SEQ ID NO: 18 - DNA, 20 bp, Artificial Sequence
  Primer MbacF (sense)
gcgaaccggattagataccc

SEQ ID NO: 19 - DNA, 20 bp, Artificial Sequence
  Primer MbacR (antisense)
agtcttgcgaccgtacttcc

SEQ ID NO: 20 - DNA, 17 bp, Artificial Sequence
  Primer BacF (sense)
actcctacgggaggcag

SEQ ID NO: 21 - DNA, 18 bp, Artificial Sequence
  Primer BacR (antisense)
gtattaccgcggctgctg

The invention claimed is:

1. A method for reducing or suppressing trimethylamine (TMA) present in a human cavity in a human patient in need thereof, comprising:
   administering an effective amount of a composition containing a methanogenic Archaea expressing a TMA methyltransferase, wherein said expressed TMA methyltransferase is capable of reducing or suppressing TMA in said cavity through metabolizing TMA in the presence of hydrogen in said human cavity, and
   having the methanogenic Archaea delivered into the human cavity which is the intestine which comprises microbial flora able to produce said TMA,
   wherein the methanogenic Archaea when present in the intestine has a TMA metabolism, produces TMA methyltransferase, and metabolizes intestinal TMA in the presence of $H_2$, and
   whereby said TMA present in the intestine is metabolized in the intestine to methane, and TMA is reduced or suppressed in the intestine and in the liver.

2. The method according to claim 1, for treating trimethylaminuria.

3. The method according to claim 1, wherein the method also reduces the plasma trimethylamine-N-oxide (TMAO) produced from said TMA in the liver as a result of TMA reduction or suppression in the intestine and in the liver, wherein TMAO may contribute to the development of atheromatous plaques in the arteries.

4. The method according to claim 1, wherein the methanogenic Archaea also expresses a corrinoid protein accepting a methyl group from TMA.

5. The method according to claim 1, wherein the methanogenic Archaea comprises the gene coding for a TMA methyltransferase of sequence SEQ ID NO: 1 or 2.

6. The method according to claim 1, wherein the methanogenic Archaea comprises the gene coding for a TMA methyltransferase, the gene having the sequence SEQ ID NO: 3 or 4.

7. The method according to claim 1, wherein the methanogenic Archaea also includes a gene for resistance to biliary salts.

8. The method according to claim 1, wherein the RNA 16S of the methanogenic Archaea is coded by the DNA sequence SEQ ID NO: 11 or 12.

9. The method according to claim 7, wherein the gene for resistance to biliary salts is choloylglycine hydrolase.

10. A method for reducing or suppressing trimethylamine (TMA) present in a human cavity in a human patient in need thereof, comprising:
    administering an effective amount of a composition containing a methanogenic Archaea the RNA 16S of which is coded by the DNA sequence SEQ ID NO: 11 or 12, a methanogenic Archaea comprising a gene coding for a TMA methyltransferase of sequence SEQ ID NO: 1 or 2, or a methanogenic Archaea containing a TMA methyltransferase of sequence SEQ ID NO: 1 or 2, wherein said TMA methyltransferase is capable of reducing or suppressing TMA in said cavity through metabolizing TMA in the presence of hydrogen in said human cavity, and
    having the methanogenic Archaea delivered into the human cavity which is the intestine which comprises microbial flora able to produce said TMA, wherein said methanogenic Archaea is a methanogenic Archaea that when present in the intestine has a TMA metabolism, wherein said methanogenic Archaea produces TMA methyltransferase and metabolizes intestinal TMA in the presence of $H_2$, and
    whereby said TMA present in the intestine is metabolized in the intestine to methane and TMA is reduced or suppressed in the intestine and in the liver.

* * * * *